United States Patent 12,097,253 (RSV RNA MOLECULES AND COMPOSITIONS FOR VACCINATION) - sequence listing, part 5

SEQ ID NO: 5197 - RNA, 1901 nt, synthetic construct
  misc_feature 1..1901: note = mRNA product Design f-3 comprising derived and/or modified sequence from HRSV(A2)__F-del_DSCav1_mut4 (opt11)
  source 1..1901: mol_type = other RNA
gggagagtcccgcagtcggcgtccagcggctctgcttgttcgtgtgtgtgtcgttgcaggccttattcaagcttaccatggaactcctcatcctcaaagccaatgccatcaccacaatcctgacagcagtaaccttctgcttcgcatccggacaaaacatcaccgaagaattttaccagtcaacctgctccgctgtctcaaaaggctacctctcagcccttcgcaccggctggtacacctcggtcataacaatagaactctccaatatcaaagaaaacaaatgcaacggcactgacgccaaggtaaaactcatcaaacaggaactcgataaatacaagaacgccgtaacagaactacaactactcatgcaatcaacaccggccaccggctccggttccgccatatgctccggagtggccgtgtgcaaggtcctccaccttgaaggggaagttaacaaaatcaaatcagccctcctctccactaacaaagccgtagtatccctaagcaacggtgtatccgtcctcaccttcaaagtactagacctaaagaattatatcgacaaacaactcctccccatactcaacaaacaatcctgctccataagcaacatcgaaacagtcatcgagttccagcagaaaaacaaccgactcctcgaaataacccgcgagttctcagtcaacgccggagtcaccacacccgtcagcacctacatgctgaccaactccgaactcctctccttaatcaatgacatgcccatcaccaatgaccaaaagaaactcatgtcaaacaacgtccaaatagtacgccaacaatcctactccatcatgtgcatcataaaagaagaagtactcgcctacgtcgtccaactccccctctacggcgtaatcgacaccccctgctggaaactacacacaagccccctctgcaccacaaacactaaagagggctccaacatctgtctaacccgcaccgatcgaggctggtactgcgacaacgccggatctgtctcattcttcccccaagccgaaacctgcaaagtccaatccaaccgcgtcttctgcgacaccatgaactcgagaaccctcccttccgaagtcaacctatgcaacgtcgacattttcaaccccaaatacgactgcaaaatcatgacctcgaaaaccgacgtatcatccagcgtcatcaccagcctaggcgcaatcgtgagctgctacggcaaaaccaaatgcaccgcgagcaataaaaaccgcgggatcatcaaaactttctccaacggctgcgactacgtctccaacaagggagtcgataccgtctccgtaggcaacaccctctactgcgtcaacaaacaagaaggcaaatcactatacgtaaaaggcgagccaatcataaacttctacgaccctctagttttcccatccgacgagttcgacgctagcatctcccaagtcaacgagaaaatcaaccaatccctcgcattcatccgcaaatccgacgaactcctccacaacgtaaacgcaggcaaatcaactactaatataatgatcacaaccatcataatagtcataatcgtaatcctcctatccctcatcgccgtcggactactgctctactgcaaagcccgctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5198 - RNA, 2117 nt, synthetic construct
  misc_feature 1..2117: note = mRNA product Design f-4 comprising derived and/or modified sequence from HRSV(A2)__F-del_DSCav1_mut4 (opt1)
  source 1..2117: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5199 - RNA, 2117 nt, synthetic construct
  misc_feature 1..2117: note = mRNA product Design f-4 comprising derived and/or modified sequence from HRSV(A2)__F-del_DSCav1_mut4 (opt1)
  source 1..2117: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatctgcagcggcgtggccgtgtgcaaggtcctgcacctcgagggcgaggtgaacaagatcaagtccgcgctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgccggctccgtgagcttcttcccccaggcggagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactgcgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgccttcatccgcaagagcgacgagctgctgcacaacgtgaacgcggggaagtccaccaccaacatcatgatcaccacgatcatcatcgtgatcatcgtcatcctcctgagcctgatcgccgtgggcctcctgctgtactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5200 - RNA, 2117 nt, synthetic construct
  misc_feature 1..2117: note = mRNA product Design f-4 comprising derived and/or modified sequence from HRSV(A2)__F-del_DSCav1_mut4 (opt2)
  source 1..2117: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5201 - RNA, 2117 nt, synthetic construct
  misc_feature 1..2117: note = mRNA product Design f-4 comprising derived and/or modified sequence from HRSV(A2)__F-del_DSCav1_mut4 (opt3)
  source 1..2117: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatatgtagcggagtggcagtctgcaaggtgttgcacctcgagggcgaagttaacaaaatcaagagtgccctgctgtccacgaataaagctgtggtctctctcagcaacggtgtgtccgtattaacttttaaggttctggaccttaagaattacattgataaacaattgctgcctatcctaaacaagcagtcatgtagtattagcaatatcgagaccgtgatagagttccagcagaaaaacaataggctcctggaaattacacgggagttttctgtcaacgccggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgcattataaaggaggaagtgttagcgtatgtagtgcaactgcccctctacggagtcatcgacactccttgttggaaacttcatacaagcccactgtgcaccactaatacaaaggagggctcgaacatttgtttgacccgaacggatcgtggctggtactgcgacaatgcagggtctgtgtccttctttccccaggccgaaacctgtaaggttcagtcaaacagagtgttctgcgatacaatgaatagtagaactctgcctagcgaggtcaacctctgcaatgtggacatctttaacccaaaatatgattgtaagataatgacctccaaaacagacgtatctagctcagttattaccagtctgggagctatcgtgtcctgctacggtaagactaaatgtacagccagcaataagaacaggggcatcattaagaccttctctaatgggtgcgattatgtctcaaacaaaggagtggacactgtcagtgtgggcaatacgctttactgtgttaacaagcaagagggtaaaagcctgtatgtgaagggggaacccatcattaacttttacgaccctttggtattcccatccgatgagtttgacgcatctatatcgcaggtcaatgagaaaatcaaccagagcctcgctttcattcggaagtccgatgaactgttacacaatgtgaacgccggaaagtcaacaaccaatatcatgatcactaccattataatcgttattatcgtgattctgctaagtctcatcgcggtcggcctgcttttgtattgcaaagcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5202 - RNA, 2117 nt, synthetic construct
  misc_feature 1..2117: note = mRNA product Design f-4 comprising derived and/or modified sequence from HRSV(A2)__F-del_DSCav1_mut4 (opt4)
  source 1..2117: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5203 - RNA, 2117 nt, synthetic construct
  misc_feature 1..2117: note = mRNA product Design f-4 comprising derived and/or modified sequence from HRSV(A2)__F-del_DSCav1_mut4 (opt5)
  source 1..2117: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctatttgttccggcgtcgccgtgtgcaaggttctccacctggagggggaagtgaacaaaatcaagagcgcgcttctgtctaccaataaagccgtcgtgtccctcagcaacggagtttctgtgctgacatttaaggtccttgacctgaagaattacattgataaacaactcctgcctatcctgaacaagcagtcctgtagcatttctaatatcgagaccgtgattgagttccagcagaaaaacaatcggctcctggaaatcacgcgcgagttttccgtgaacgctggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgcatcattaaggaggaagtcctggcctatgtggttcaactccctctgtacggcgtgatcgacacaccctgttggaaactgcatacgtctcctctctgcaccacaaataccaaggaggggtccaacatctgtctgacacggaccgatcgcggatggtactgcgacaatgctggcagcgtctctttctttccccaggccgaaacgtgtaaggtgcagagcaacagagttttctgcgatacaatgaactccagaaccctgccttctgaggtgaatctctgcaatgtcgacatttttaacccgaaatatgattgtaagatcatgaccagcaaaacagacgtgtccagctctgtcattacctccctgggggcgatcgtgagctgctacggaaagacaaaatgtacggcctctaataagaaccggggcattatcaagaccttctccaatgggtgcgattatgttagcaacaaaggagtggacacagtctccgtgggcaataccctttactgtgttaacaagcaagagggcaaatctctgtatgtgaagggggaacccatcattaacttttacgaccctctcgtcttccccagcgatgagtttgacgcttccatctctcaggtgaatgagaaaattaaccagagcctggccttcatccgcaagtccgatgaactgctccacaatgtgaacgctggaaagagcacaaccaatattatgatcacgaccattatcatcgttattatcgtcattctgctttctctgatcgccgtgggcctcctgctgtattgcaaagccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5204 - RNA, 2117 nt, synthetic construct
  misc_feature 1..2117: note = mRNA product Design f-4 comprising derived and/or modified sequence from HRSV(A2)__F-del_DSCav1_mut4 (opt6)
  source 1..2117: mol_type = other RNA
gggagagtcccgcagtcggcgtccagcggctctgcttgttcgtgtgtgtgtcgttgcaggccttattcaagcttaccatggaacttttaatactaaaagctaacgccataaccactatactaacagcagtcacattctgcttcgcatcaggccaaaacataaccgaagaattttaccaatccacttgttcagcagtctccaaaggatatttatccgcacttcgtacaggatggtatacatcagtaataacaatagaactctccaacataaaagaaaataaatgcaacggcaccgacgcaaaagtaaaactcatcaaacaagaattagacaaatacaagaacgccgtaacagaactacaattactaatgcaatcaacacccgccacaggatcaggatctgcaatatgctctggagtagcagtatgcaaagtattacacctagaaggagaagtaaacaaaatcaaaagcgcactactatccacaaacaaagctgtagtatcactatcaaacggagtatcagtattaactttcaaagtacttgatctaaaaaactacatagacaaacaactactacccatattaaacaaacaatcatgctcaataagcaatatagaaacagtaatagaatttcaacaaaaaaacaacagactactagaaatcacaagggaattttcagtaaatgccggtgttacaaccccagtatcaacatacatgctaactaactcagaactactatccttaataaacgatatgccaataacaaacgatcaaaaaaaactaatgtccaacaacgtacaaatagtaagacaacaatcatactcaatcatgtgcattataaaagaagaagtcttagcatacgtagtacaattaccactatacggtgtaatagatacaccatgttggaaattacacacaagcccactatgcacaactaacacaaaagaaggctcaaatatatgtttaacaagaacagaccgaggttggtactgcgacaatgcaggatcagtatcattctttccacaagcagaaacatgtaaagttcaatccaacagagtattctgcgacacaatgaactccagaacactaccttcagaagtaaacctctgtaacgtagacatatttaatcccaagtacgactgcaaaataatgacatcgaaaacagacgtaagctcctcagtgataacatccctcggcgccatcgtatcctgttacggtaaaactaaatgtaccgcctcaaacaaaaaccgcggtattataaaaactttttctaatggctgcgattacgtaagcaacaaaggcgtcgacacagtttccgtaggaaacacactatactgcgtaaacaaacaagaaggtaaatctctatacgtaaaaggagaaccaataataaatttctatgatcctttagtattcccatccgatgaatttgacgcctctatctcacaagtcaacgaaaaaataaatcaatcattagcattcatacgaaaatcagacgaactactacacaacgtaaacgcaggaaaatcaacaaccaacataatgataaccacaataataatagttattatagtgatactattatccttaattgcagtcggactattattatactgtaaagcacgctaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5205 - RNA, 2117 nt, synthetic construct
  misc_feature 1..2117: note = mRNA product Design f-4 comprising derived and/or modified sequence from HRSV(A2)__F-del_DSCav1_mut4 (opt11)
  source 1..2117: mol_type = other RNA
gggagagtcccgcagtcggcgtccagcggctctgcttgttcgtgtgtgtgtcgttgcaggccttattcaagcttaccatggaactcctcatcctcaaagccaatgccatcaccacaatcctgacagcagtaaccttctgcttcgcatccggacaaaacatcaccgaagaattttaccagtcaacctgctccgctgtctcaaaaggctacctctcagcccttcgcaccggctggtacacctcggtcataacaatagaactctccaatatcaaagaaaacaaatgcaacggcactgacgccaaggtaaaactcatcaaacaggaactcgataaatacaagaacgccgtaacagaactacaactactcatgcaatcaacaccggccaccggctccggttccgccatatgctccggagtggccgtgtgcaaggtcctccaccttgaaggggaagttaacaaaatcaaatcagccctcctctccactaacaaagccgtagtatccctaagcaacggtgtatccgtcctcaccttcaaagtactagacctaaagaattatatcgacaaacaactcctccccatactcaacaaacaatcctgctccataagcaacatcgaaacagtcatcgagttccagcagaaaaacaaccgactcctcgaaataacccgcgagttctcagtcaacgccggagtcaccacacccgtcagcacctacatgctgaccaactccgaactcctctccttaatcaatgacatgcccatcaccaatgaccaaaagaaactcatgtcaaacaacgtccaaatagtacgccaacaatcctactccatcatgtgcatcataaaagaagaagtactcgcctacgtcgtccaactccccctctacggcgtaatcgacaccccctgctggaaactacacacaagccccctctgcaccacaaacactaaagagggctccaacatctgtctaacccgcaccgatcgaggctggtactgcgacaacgccggatctgtctcattcttcccccaagccgaaacctgcaaagtccaatccaaccgcgtcttctgcgacaccatgaactcgagaaccctcccttccgaagtcaacctatgcaacgtcgacattttcaaccccaaatacgactgcaaaatcatgacctcgaaaaccgacgtatcatccagcgtcatcaccagcctaggcgcaatcgtgagctgctacggcaaaaccaaatgcaccgcgagcaataaaaaccgcgggatcatcaaaactttctccaacggctgcgactacgtctccaacaagggagtcgataccgtctccgtaggcaacaccctctactgcgtcaacaaacaagaaggcaaatcactatacgtaaaaggcgagccaatcataaacttctacgaccctctagttttcccatccgacgagttcgacgctagcatctcccaagtcaacgagaaaatcaaccaatccctcgcattcatccgcaaatccgacgaactcctccacaacgtaaacgcaggcaaatcaactactaatataatgatcacaaccatcataatagtcataatcgtaatcctcctatccctcatcgccgtcggactactgctctactgcaaagcccgctaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5206 - RNA, 1893 nt, synthetic construct
  misc_feature 1..1893: note = mRNA product Design f-5 comprising derived and/or modified sequence from HRSV(A2)__F-del_DSCav1_mut4 (opt1)
  source 1..1893: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5207 - RNA, 1893 nt, synthetic construct
  misc_feature 1..1893: note = mRNA product Design f-5 comprising derived and/or modified sequence from HRSV(A2)__F-del_DSCav1_mut4 (opt1)
  source 1..1893: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatctgcagcggcgtggccgtgtgcaaggtcctgcacctcgagggcgaggtgaacaagatcaagtccgcgctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgccggctccgtgagcttcttcccccaggcggagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactgcgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgccttcatccgcaagagcgacgagctgctgcacaacgtgaacgcggggaagtccaccaccaacatcatgatcaccacgatcatcatcgtgatcatcgtcatcctcctgagcctgatcgccgtgggcctcctgctgtactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5208 - RNA, 1893 nt, synthetic construct
  misc_feature 1..1893: note = mRNA product Design f-5 comprising derived and/or modified sequence from HRSV(A2)__F-del_DSCav1_mut4 (opt2)
  source 1..1893: mol_type = other RNA
gggagactttcccattctgtagcagaatttggtgttgcctgtggtcttggtcccgcggagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5209 - RNA, 1893 nt, synthetic construct
  misc_feature 1..1893: note = mRNA product Design f-5 comprising derived and/or modified sequence from HRSV(A2)__F-del_DSCav1_mut4 (opt3)
  source 1..1893: mol_type = other RNA
gggagactttcccattctgtagcagaatttggtgttgcctgtggtcttggtcccgcggagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatatgtagcggagtggcagtctgcaaggtgttgcacctcgagggcgaagttaacaaaatcaagagtgccctgctgtccacgaataaagctgtggtctctctcagcaacggtgtgtccgtattaacttttaaggttctggaccttaagaattacattgataaacaattgctgcctatcctaaacaagcagtcatgtagtattagcaatatcgagaccgtgatagagttccagcagaaaaacaataggctcctggaaattacacgggagttttctgtcaacgccggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgcattataaaggaggaagtgttagcgtatgtagtgcaactgcccctctacggagtcatcgacactccttgttggaaacttcatacaagcccactgtgcaccactaatacaaaggagggctcgaacatttgtttgacccgaacggatcgtggctggtactgcgacaatgcagggtctgtgtccttctttccccaggccgaaacctgtaaggttcagtcaaacagagtgttctgcgatacaatgaatagtagaactctgcctagcgaggtcaacctctgcaatgtggacatctttaacccaaaatatgattgtaagataatgacctccaaaacagacgtatctagctcagttattaccagtctgggagctatcgtgtcctgctacggtaagactaaatgtacagccagcaataagaacaggggcatcattaagaccttctctaatgggtgcgattatgtctcaaacaaaggagtggacactgtcagtgtgggcaatacgctttactgtgttaacaagcaagagggtaaaagcctgtatgtgaagggggaacccatcattaacttttacgaccctttggtattcccatccgatgagtttgacgcatctatatcgcaggtcaatgagaaaatcaaccagagcctcgctttcattcggaagtccgatgaactgttacacaatgtgaacgccggaaagtcaacaaccaatatcatgatcactaccattataatcgttattatcgtgattctgctaagtctcatcgcggtcggcctgcttttgtattgcaaagcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5210 - RNA, 1893 nt, synthetic construct
  misc_feature 1..1893: note = mRNA product Design f-5 comprising derived and/or modified sequence from HRSV(A2)__F-del_DSCav1_mut4 (opt4)
  source 1..1893: mol_type = other RNA
gggagactttcccattctgtagcagaatttggtgttgcctgtggtcttggtcccgcggagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5211 - RNA, 1893 nt, synthetic construct
  misc_feature 1..1893: note = mRNA product Design f-5 comprising derived and/or modified sequence from HRSV(A2)__F-del_DSCav1_mut4 (opt5)
  source 1..1893: mol_type = other RNA
gggagactttcccattctgtagcagaatttggtgttgcctgtggtcttggtcccgcggagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctatttgttccggcgtcgccgtgtgcaaggttctccacctggagggggaagtgaacaaaatcaagagcgcgcttctgtctaccaataaagccgtcgtgtccctcagcaacggagtttctgtgctgacatttaaggtccttgacctgaagaattacattgataaacaactcctgcctatcctgaacaagcagtcctgtagcatttctaatatcgagaccgtgattgagttccagcagaaaaacaatcggctcctggaaatcacgcgcgagttttccgtgaacgctggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgcatcattaaggaggaagtcctggcctatgtggttcaactccctctgtacggcgtgatcgacacaccctgttggaaactgcatacgtctcctctctgcaccacaaataccaaggaggggtccaacatctgtctgacacggaccgatcgcggatggtactgcgacaatgctggcagcgtctctttctttccccaggccgaaacgtgtaaggtgcagagcaacagagttttctgcgatacaatgaactccagaaccctgccttctgaggtgaatctctgcaatgtcgacatttttaacccgaaatatgattgtaagatcatgaccagcaaaacagacgtgtccagctctgtcattacctccctgggggcgatcgtgagctgctacggaaagacaaaatgtacggcctctaataagaaccggggcattatcaagaccttctccaatgggtgcgattatgttagcaacaaaggagtggacacagtctccgtgggcaataccctttactgtgttaacaagcaagagggcaaatctctgtatgtgaagggggaacccatcattaacttttacgaccctctcgtcttccccagcgatgagtttgacgcttccatctctcaggtgaatgagaaaattaaccagagcctggccttcatccgcaagtccgatgaactgctccacaatgtgaacgctggaaagagcacaaccaatattatgatcacgaccattatcatcgttattatcgtcattctgctttctctgatcgccgtgggcctcctgctgtattgcaaagccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5212 - RNA, 1893 nt, synthetic construct
  misc_feature 1..1893: note = mRNA product Design f-5 comprising derived and/or modified sequence from HRSV(A2)__F-del_DSCav1_mut4 (opt6)
  source 1..1893: mol_type = other RNA
gggagactttcccattctgtagcagaatttggtgttgcctgtggtcttggtcccgcggagaagcttaccatggaacttttaatactaaaagctaacgccataaccactatactaacagcagtcacattctgcttcgcatcaggccaaaacataaccgaagaattttaccaatccacttgttcagcagtctccaaaggatatttatccgcacttcgtacaggatggtatacatcagtaataacaatagaactctccaacataaaagaaaataaatgcaacggcaccgacgcaaaagtaaaactcatcaaacaagaattagacaaatacaagaacgccgtaacagaactacaattactaatgcaatcaacacccgccacaggatcaggatctgcaatatgctctggagtagcagtatgcaaagtattacacctagaaggagaagtaaacaaaatcaaaagcgcactactatccacaaacaaagctgtagtatcactatcaaacggagtatcagtattaactttcaaagtacttgatctaaaaaactacatagacaaacaactactacccatattaaacaaacaatcatgctcaataagcaatatagaaacagtaatagaatttcaacaaaaaaacaacagactactagaaatcacaagggaattttcagtaaatgccggtgttacaaccccagtatcaacatacatgctaactaactcagaactactatccttaataaacgatatgccaataacaaacgatcaaaaaaaactaatgtccaacaacgtacaaatagtaagacaacaatcatactcaatcatgtgcattataaaagaagaagtcttagcatacgtagtacaattaccactatacggtgtaatagatacaccatgttggaaattacacacaagcccactatgcacaactaacacaaaagaaggctcaaatatatgtttaacaagaacagaccgaggttggtactgcgacaatgcaggatcagtatcattctttccacaagcagaaacatgtaaagttcaatccaacagagtattctgcgacacaatgaactccagaacactaccttcagaagtaaacctctgtaacgtagacatatttaatcccaagtacgactgcaaaataatgacatcgaaaacagacgtaagctcctcagtgataacatccctcggcgccatcgtatcctgttacggtaaaactaaatgtaccgcctcaaacaaaaaccgcggtattataaaaactttttctaatggctgcgattacgtaagcaacaaaggcgtcgacacagtttccgtaggaaacacactatactgcgtaaacaaacaagaaggtaaatctctatacgtaaaaggagaaccaataataaatttctatgatcctttagtattcccatccgatgaatttgacgcctctatctcacaagtcaacgaaaaaataaatcaatcattagcattcatacgaaaatcagacgaactactacacaacgtaaacgcaggaaaatcaacaaccaacataatgataaccacaataataatagttattatagtgatactattatccttaattgcagtcggactattattatactgtaaagcacgctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5213 - RNA, 1893 nt, synthetic construct
  misc_feature 1..1893: note = mRNA product Design f-5 comprising derived and/or modified sequence from HRSV(A2)__F-del_DSCav1_mut4 (opt11)
  source 1..1893: mol_type = other RNA
gggagactttcccattctgtagcagaatttggtgttgcctgtggtcttggtcccgcggagaagcttaccatggaactcctcatcctcaaagccaatgccatcaccacaatcctgacagcagtaaccttctgcttcgcatccggacaaaacatcaccgaagaattttaccagtcaacctgctccgctgtctcaaaaggctacctctcagcccttcgcaccggctggtacacctcggtcataacaatagaactctccaatatcaaagaaaacaaatgcaacggcactgacgccaaggtaaaactcatcaaacaggaactcgataaatacaagaacgccgtaacagaactacaactactcatgcaatcaacaccggccaccggctccggttccgccatatgctccggagtggccgtgtgcaaggtcctccaccttgaaggggaagttaacaaaatcaaatcagccctcctctccactaacaaagccgtagtatccctaagcaacggtgtatccgtcctcaccttcaaagtactagacctaaagaattatatcgacaaacaactcctccccatactcaacaaacaatcctgctccataagcaacatcgaaacagtcatcgagttccagcagaaaaacaaccgactcctcgaaataacccgcgagttctcagtcaacgccggagtcaccacacccgtcagcacctacatgctgaccaactccgaactcctctccttaatcaatgacatgcccatcaccaatgaccaaaagaaactcatgtcaaacaacgtccaaatagtacgccaacaatcctactccatcatgtgcatcataaaagaagaagtactcgcctacgtcgtccaactccccctctacggcgtaatcgacaccccctgctggaaactacacacaagccccctctgcaccacaaacactaaagagggctccaacatctgtctaacccgcaccgatcgaggctggtactgcgacaacgccggatctgtctcattcttcccccaagccgaaacctgcaaagtccaatccaaccgcgtcttctgcgacaccatgaactcgagaaccctcccttccgaagtcaacctatgcaacgtcgacattttcaaccccaaatacgactgcaaaatcatgacctcgaaaaccgacgtatcatccagcgtcatcaccagcctaggcgcaatcgtgagctgctacggcaaaaccaaatgcaccgcgagcaataaaaaccgcgggatcatcaaaactttctccaacggctgcgactacgtctccaacaagggagtcgataccgtctccgtaggcaacaccctctactgcgtcaacaaacaagaaggcaaatcactatacgtaaaaggcgagccaatcataaacttctacgaccctctagttttcccatccgacgagttcgacgctagcatctcccaagtcaacgagaaaatcaaccaatccctcgcattcatccgcaaatccgacgaactcctccacaacgtaaacgcaggcaaatcaactactaatataatgatcacaaccatcataatagtcataatcgtaatcctcctatccctcatcgccgtcggactactgctctactgcaaagcccgctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5214 - RNA, 1889 nt, synthetic construct
  misc_feature 1..1889: note = mRNA product Design g-1 comprising derived and/or modified sequence from HRSV(A2)__F-del_DSCav1_mut4 (opt1)
  source 1..1889: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5215 - RNA, 1889 nt, synthetic construct
  misc_feature 1..1889: note = mRNA product Design g-1 comprising derived and/or modified sequence from HRSV(A2)__F-del_DSCav1_mut4 (opt1)
  source 1..1889: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatctgcagcggcgtggccgtgtgcaaggtcctgcacctcgagggcgaggtgaacaagatcaagtccgcgctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgccggctccgtgagcttcttcccccaggcggagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactgcgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgccttcatccgcaagagcgacgagctgctgcacaacgtgaacgcggggaagtccaccaccaacatcatgatcaccacgatcatcatcgtgatcatcgtcatcctcctgagcctgatcgccgtgggcctcctgctgtactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5216 - RNA, 1889 nt, synthetic construct
  misc_feature 1..1889: note = mRNA product Design g-1 comprising derived and/or modified sequence from HRSV(A2)__F-del_DSCav1_mut4 (opt2)
  source 1..1889: mol_type = other RNA
gggagactttcccattctgtagcagaatttggtgttgcctgtggtcttggtcccgcggagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5217 - RNA, 1889 nt, synthetic construct
  misc_feature 1..1889: note = mRNA product Design g-1 comprising derived and/or modified sequence from HRSV(A2)__F-del_DSCav1_mut4 (opt3)
  source 1..1889: mol_type = other RNA
gggagactttcccattctgtagcagaatttggtgttgcctgtggtcttggtcccgcggagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatatgtagcggagtggcagtctgcaaggtgttgcacctcgagggcgaagttaacaaaatcaagagtgccctgctgtccacgaataaagctgtggtctctctcagcaacggtgtgtccgtattaacttttaaggttctggaccttaagaattacattgataaacaattgctgcctatcctaaacaagcagtcatgtagtattagcaatatcgagaccgtgatagagttccagcagaaaaacaataggctcctggaaattacacgggagttttctgtcaacgccggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgcattataaaggaggaagtgttagcgtatgtagtgcaactgcccctctacggagtcatcgacactccttgttggaaacttcatacaagcccactgtgcaccactaatacaaaggagggctcgaacatttgtttgacccgaacggatcgtggctggtactgcgacaatgcagggtctgtgtccttctttccccaggccgaaacctgtaaggttcagtcaaacagagtgttctgcgatacaatgaatagtagaactctgcctagcgaggtcaacctctgcaatgtggacatctttaacccaaaatatgattgtaagataatgacctccaaaacagacgtatctagctcagttattaccagtctgggagctatcgtgtcctgctacggtaagactaaatgtacagccagcaataagaacaggggcatcattaagaccttctctaatgggtgcgattatgtctcaaacaaaggagtggacactgtcagtgtgggcaatacgctttactgtgttaacaagcaagagggtaaaagcctgtatgtgaagggggaacccatcattaacttttacgaccctttggtattcccatccgatgagtttgacgcatctatatcgcaggtcaatgagaaaatcaaccagagcctcgctttcattcggaagtccgatgaactgttacacaatgtgaacgccggaaagtcaacaaccaatatcatgatcactaccattataatcgttattatcgtgattctgctaagtctcatcgcggtcggcctgcttttgtattgcaaagcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5218 - RNA, 1889 nt, synthetic construct
  misc_feature 1..1889: note = mRNA product Design g-1 comprising derived and/or modified sequence from HRSV(A2)__F-del_DSCav1_mut4 (opt4)
  source 1..1889: mol_type = other RNA
gggagactttcccattctgtagcagaatttggtgttgcctgtggtcttggtcccgcggagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5219 - RNA, 1889 nt, synthetic construct
  misc_feature 1..1889: note = mRNA product Design g-1 comprising derived and/or modified sequence from HRSV(A2)__F-del_DSCav1_mut4 (opt5)
  source 1..1889: mol_type = other RNA
gggagactttcccattctgtagcagaatttggtgttgcctgtggtcttggtcccgcggagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctatttgttccggcgtcgccgtgtgcaaggttctccacctggagggggaagtgaacaaaatcaagagcgcgcttctgtctaccaataaagccgtcgtgtccctcagcaacggagtttctgtgctgacatttaaggtccttgacctgaagaattacattgataaacaactcctgcctatcctgaacaagcagtcctgtagcatttctaatatcgagaccgtgattgagttccagcagaaaaacaatcggctcctggaaatcacgcgcgagttttccgtgaacgctggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgcatcattaaggaggaagtcctggcctatgtggttcaactccctctgtacggcgtgatcgacacaccctgttggaaactgcatacgtctcctctctgcaccacaaataccaaggaggggtccaacatctgtctgacacggaccgatcgcggatggtactgcgacaatgctggcagcgtctctttctttccccaggccgaaacgtgtaaggtgcagagcaacagagttttctgcgatacaatgaactccagaaccctgccttctgaggtgaatctctgcaatgtcgacatttttaacccgaaatatgattgtaagatcatgaccagcaaaacagacgtgtccagctctgtcattacctccctgggggcgatcgtgagctgctacggaaagacaaaatgtacggcctctaataagaaccggggcattatcaagaccttctccaatgggtgcgattatgttagcaacaaaggagtggacacagtctccgtgggcaataccctttactgtgttaacaagcaagagggcaaatctctgtatgtgaagggggaacccatcattaacttttacgaccctctcgtcttccccagcgatgagtttgacgcttccatctctcaggtgaatgagaaaattaaccagagcctggccttcatccgcaagtccgatgaactgctccacaatgtgaacgctggaaagagcacaaccaatattatgatcacgaccattatcatcgttattatcgtcattctgctttctctgatcgccgtgggcctcctgctgtattgcaaagccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5220 - RNA, 1889 nt, synthetic construct
  misc_feature 1..1889: note = mRNA product Design g-1 comprising derived and/or modified sequence from HRSV(A2)__F-del_DSCav1_mut4 (opt6)
  source 1..1889: mol_type = other RNA
gggagactttcccattctgtagcagaatttggtgttgcctgtggtcttggtcccgcggagaagcttaccatggaacttttaatactaaaagctaacgccataaccactatactaacagcagtcacattctgcttcgcatcaggccaaaacataaccgaagaattttaccaatccacttgttcagcagtctccaaaggatatttatccgcacttcgtacaggatggtatacatcagtaataacaatagaactctccaacataaaagaaaataaatgcaacggcaccgacgcaaaagtaaaactcatcaaacaagaattagacaaatacaagaacgccgtaacagaactacaattactaatgcaatcaacacccgccacaggatcaggatctgcaatatgctctggagtagcagtatgcaaagtattacacctagaaggagaagtaaacaaaatcaaaagcgcactactatccacaaacaaagctgtagtatcactatcaaacggagtatcagtattaactttcaaagtacttgatctaaaaaactacatagacaaacaactactacccatattaaacaaacaatcatgctcaataagcaatatagaaacagtaatagaatttcaacaaaaaaacaacagactactagaaatcacaagggaattttcagtaaatgccggtgttacaaccccagtatcaacatacatgctaactaactcagaactactatccttaataaacgatatgccaataacaaacgatcaaaaaaaactaatgtccaacaacgtacaaatagtaagacaacaatcatactcaatcatgtgcattataaaagaagaagtcttagcatacgtagtacaattaccactatacggtgtaatagatacaccatgttggaaattacacacaagcccactatgcacaactaacacaaaagaaggctcaaatatatgtttaacaagaacagaccgaggttggtactgcgacaatgcaggatcagtatcattctttccacaagcagaaacatgtaaagttcaatccaacagagtattctgcgacacaatgaactccagaacactaccttcagaagtaaacctctgtaacgtagacatatttaatcccaagtacgactgcaaaataatgacatcgaaaacagacgtaagctcctcagtgataacatccctcggcgccatcgtatcctgttacggtaaaactaaatgtaccgcctcaaacaaaaaccgcggtattataaaaactttttctaatggctgcgattacgtaagcaacaaaggcgtcgacacagtttccgtaggaaacacactatactgcgtaaacaaacaagaaggtaaatctctatacgtaaaaggagaaccaataataaatttctatgatcctttagtattcccatccgatgaatttgacgcctctatctcacaagtcaacgaaaaaataaatcaatcattagcattcatacgaaaatcagacgaactactacacaacgtaaacgcaggaaaatcaacaaccaacataatgataaccacaataataatagttattatagtgatactattatccttaattgcagtcggactattattatactgtaaagcacgctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5221 - RNA, 1889 nt, synthetic construct
  misc_feature 1..1889: note = mRNA product Design g-1 comprising derived and/or modified sequence from HRSV(A2)__F-del_DSCav1_mut4 (opt11)
  source 1..1889: mol_type = other RNA
gggagactttcccattctgtagcagaatttggtgttgcctgtggtcttggtcccgcggagaagcttaccatggaactcctcatcctcaaagccaatgccatcaccacaatcctgacagcagtaaccttctgcttcgcatccggacaaaacatcaccgaagaattttaccagtcaacctgctccgctgtctcaaaaggctacctctcagcccttcgcaccggctggtacacctcggtcataacaatagaactctccaatatcaaagaaaacaaatgcaacggcactgacgccaaggtaaaactcatcaaacaggaactcgataaatacaagaacgccgtaacagaactacaactactcatgcaatcaacaccggccaccggctccggttccgccatatgctccggagtggccgtgtgcaaggtcctccaccttgaaggggaagttaacaaaatcaaatcagccctcctctccactaacaaagccgtagtatccctaagcaacggtgtatccgtcctcaccttcaaagtactagacctaaagaattatatcgacaaacaactcctccccatactcaacaaacaatcctgctccataagcaacatcgaaacagtcatcgagttccagcagaaaaacaaccgactcctcgaaataacccgcgagttctcagtcaacgccggagtcaccacacccgtcagcacctacatgctgaccaactccgaactcctctccttaatcaatgacatgcccatcaccaatgaccaaaagaaactcatgtcaaacaacgtccaaatagtacgccaacaatcctactccatcatgtgcatcataaaagaagaagtactcgcctacgtcgtccaactccccctctacggcgtaatcgacaccccctgctggaaactacacacaagccccctctgcaccacaaacactaaagagggctccaacatctgtctaacccgcaccgatcgaggctggtactgcgacaacgccggatctgtctcattcttcccccaagccgaaacctgcaaagtccaatccaaccgcgtcttctgcgacaccatgaactcgagaaccctcccttccgaagtcaacctatgcaacgtcgacattttcaaccccaaatacgactgcaaaatcatgacctcgaaaaccgacgtatcatccagcgtcatcaccagcctaggcgcaatcgtgagctgctacggcaaaaccaaatgcaccgcgagcaataaaaaccgcgggatcatcaaaactttctccaacggctgcgactacgtctccaacaagggagtcgataccgtctccgtaggcaacaccctctactgcgtcaacaaacaagaaggcaaatcactatacgtaaaaggcgagccaatcataaacttctacgaccctctagttttcccatccgacgagttcgacgctagcatctcccaagtcaacgagaaaatcaaccaatccctcgcattcatccgcaaatccgacgaactcctccacaacgtaaacgcaggcaaatcaactactaatataatgatcacaaccatcataatagtcataatcgtaatcctcctatccctcatcgccgtcggactactgctctactgcaaagcccgctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5222 - RNA, 1904 nt, synthetic construct
  misc_feature 1..1904: note = mRNA product Design g-2 comprising derived and/or modified sequence from HRSV(A2)__F-del_DSCav1_mut4 (opt1)
  source 1..1904: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5223 - RNA, 1904 nt, synthetic construct
  misc_feature 1..1904: note = mRNA product Design g-2 comprising derived and/or modified sequence from HRSV(A2)__F-del_DSCav1_mut4 (opt1)
  source 1..1904: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatctgcagcggcgtggccgtgtgcaaggtcctgcacctcgagggcgaggtgaacaagatcaagtccgcgctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgccggctccgtgagcttcttcccccaggcggagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactgcgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgccttcatccgcaagagcgacgagctgctgcacaacgtgaacgcggggaagtccaccaccaacatcatgatcaccacgatcatcatcgtgatcatcgtcatcctcctgagcctgatcgccgtgggcctcctgctgtactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5224 - RNA, 1904 nt, synthetic construct
  misc_feature 1..1904: note = mRNA product Design g-2 comprising derived and/or modified sequence from HRSV(A2)__F-del_DSCav1_mut4 (opt2)
  source 1..1904: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5225 - RNA, 1904 nt, synthetic construct
  misc_feature 1..1904: note = mRNA product Design g-2 comprising derived and/or modified sequence from HRSV(A2)__F-del_DSCav1_mut4 (opt3)
  source 1..1904: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatatgtagcggagtggcagtctgcaaggtgttgcacctcgagggcgaagttaacaaaatcaagagtgccctgctgtccacgaataaagctgtggtctctctcagcaacggtgtgtccgtattaacttttaaggttctggaccttaagaattacattgataaacaattgctgcctatcctaaacaagcagtcatgtagtattagcaatatcgagaccgtgatagagttccagcagaaaaacaataggctcctggaaattacacgggagttttctgtcaacgccggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgcattataaaggaggaagtgttagcgtatgtagtgcaactgcccctctacggagtcatcgacactccttgttggaaacttcatacaagcccactgtgcaccactaatacaaaggagggctcgaacatttgtttgacccgaacggatcgtggctggtactgcgacaatgcagggtctgtgtccttctttccccaggccgaaacctgtaaggttcagtcaaacagagtgttctgcgatacaatgaatagtagaactctgcctagcgaggtcaacctctgcaatgtggacatctttaacccaaaatatgattgtaagataatgacctccaaaacagacgtatctagctcagttattaccagtctgggagctatcgtgtcctgctacggtaagactaaatgtacagccagcaataagaacaggggcatcattaagaccttctctaatgggtgcgattatgtctcaaacaaaggagtggacactgtcagtgtgggcaatacgctttactgtgttaacaagcaagagggtaaaagcctgtatgtgaagggggaacccatcattaacttttacgaccctttggtattcccatccgatgagtttgacgcatctatatcgcaggtcaatgagaaaatcaaccagagcctcgctttcattcggaagtccgatgaactgttacacaatgtgaacgccggaaagtcaacaaccaatatcatgatcactaccattataatcgttattatcgtgattctgctaagtctcatcgcggtcggcctgcttttgtattgcaaagcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5226 - RNA, 1904 nt, synthetic construct
  misc_feature 1..1904: note = mRNA product Design g-2 comprising derived and/or modified sequence from HRSV(A2)__F-del_DSCav1_mut4 (opt4)
  source 1..1904: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5227 - RNA, 1904 nt, synthetic construct
  misc_feature 1..1904: note = mRNA product Design g-2 comprising derived and/or modified sequence from HRSV(A2)__F-del_DSCav1_mut4 (opt5)
  source 1..1904: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctatttgttccggcgtcgccgtgtgcaaggttctccacctggagggggaagtgaacaaaatcaagagcgcgcttctgtctaccaataaagccgtcgtgtccctcagcaacggagtttctgtgctgacatttaaggtccttgacctgaagaattacattgataaacaactcctgcctatcctgaacaagcagtcctgtagcatttctaatatcgagaccgtgattgagttccagcagaaaaacaatcggctcctggaaatcacgcgcgagttttccgtgaacgctggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgcatcattaaggaggaagtcctggcctatgtggttcaactccctctgtacggcgtgatcgacacaccctgttggaaactgcatacgtctcctctctgcaccacaaataccaaggaggggtccaacatctgtctgacacggaccgatcgcggatggtactgcgacaatgctggcagcgtctctttctttccccaggccgaaacgtgtaaggtgcagagcaacagagttttctgcgatacaatgaactccagaaccctgccttctgaggtgaatctctgcaatgtcgacatttttaacccgaaatatgattgtaagatcatgaccagcaaaacagacgtgtccagctctgtcattacctccctgggggcgatcgtgagctgctacggaaagacaaaatgtacggcctctaataagaaccggggcattatcaagaccttctccaatgggtgcgattatgttagcaacaaaggagtggacacagtctccgtgggcaataccctttactgtgttaacaagcaagagggcaaatctctgtatgtgaagggggaacccatcattaacttttacgaccctctcgtcttccccagcgatgagtttgacgcttccatctctcaggtgaatgagaaaattaaccagagcctggccttcatccgcaagtccgatgaactgctccacaatgtgaacgctggaaagagcacaaccaatattatgatcacgaccattatcatcgttattatcgtcattctgctttctctgatcgccgtgggcctcctgctgtattgcaaagccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5228 - RNA, 1904 nt, synthetic construct
  misc_feature 1..1904: note = mRNA product Design g-2 comprising derived and/or modified sequence from HRSV(A2)__F-del_DSCav1_mut4 (opt6)
  source 1..1904: mol_type = other RNA
gggagagtccgctcagccaggttgcagaagcggcttagcgtgtgtcctaatcttctctctgcgtgtaggtaggcctgtgccgcaaacaagcttaccatggaacttttaatactaaaagctaacgccataaccactatactaacagcagtcacattctgcttcgcatcaggccaaaacataaccgaagaattttaccaatccacttgttcagcagtctccaaaggatatttatccgcacttcgtacaggatggtatacatcagtaataacaatagaactctccaacataaaagaaaataaatgcaacggcaccgacgcaaaagtaaaactcatcaaacaagaattagacaaatacaagaacgccgtaacagaactacaattactaatgcaatcaacacccgccacaggatcaggatctgcaatatgctctggagtagcagtatgcaaagtattacacctagaaggagaagtaaacaaaatcaaaagcgcactactatccacaaacaaagctgtagtatcactatcaaacggagtatcagtattaactttcaaagtacttgatctaaaaaactacatagacaaacaactactacccatattaaacaaacaatcatgctcaataagcaatatagaaacagtaatagaatttcaacaaaaaaacaacagactactagaaatcacaagggaattttcagtaaatgccggtgttacaaccccagtatcaacatacatgctaactaactcagaactactatccttaataaacgatatgccaataacaaacgatcaaaaaaaactaatgtccaacaacgtacaaatagtaagacaacaatcatactcaatcatgtgcattataaaagaagaagtcttagcatacgtagtacaattaccactatacggtgtaatagatacaccatgttggaaattacacacaagcccactatgcacaactaacacaaaagaaggctcaaatatatgtttaacaagaacagaccgaggttggtactgcgacaatgcaggatcagtatcattctttccacaagcagaaacatgtaaagttcaatccaacagagtattctgcgacacaatgaactccagaacactaccttcagaagtaaacctctgtaacgtagacatatttaatcccaagtacgactgcaaaataatgacatcgaaaacagacgtaagctcctcagtgataacatccctcggcgccatcgtatcctgttacggtaaaactaaatgtaccgcctcaaacaaaaaccgcggtattataaaaactttttctaatggctgcgattacgtaagcaacaaaggcgtcgacacagtttccgtaggaaacacactatactgcgtaaacaaacaagaaggtaaatctctatacgtaaaaggagaaccaataataaatttctatgatcctttagtattcccatccgatgaatttgacgcctctatctcacaagtcaacgaaaaaataaatcaatcattagcattcatacgaaaatcagacgaactactacacaacgtaaacgcaggaaaatcaacaaccaacataatgataaccacaataataatagttattatagtgatactattatccttaattgcagtcggactattattatactgtaaagcacgctaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5229 - RNA, 1904 nt, synthetic construct
  misc_feature 1..1904: note = mRNA product Design g-2 comprising derived and/or modified sequence from HRSV(A2)__F-del_DSCav1_mut4 (opt11)
  source 1..1904: mol_type = other RNA
gggagagtccgctcagccaggttgcagaagcggcttagcgtgtgtcctaatcttctctctgcgtgtaggtaggcctgtgccgcaaacaagcttaccatggaactcctcatcctcaaagccaatgccatcaccacaatcctgacagcagtaaccttctgcttcgcatccggacaaaacatcaccgaagaattttaccagtcaacctgctccgctgtctcaaaaggctacctctcagcccttcgcaccggctggtacacctcggtcataacaatagaactctccaatatcaaagaaaacaaatgcaacggcactgacgccaaggtaaaactcatcaaacaggaactcgataaatacaagaacgccgtaacagaactacaactactcatgcaatcaacaccggccaccggctccggttccgccatatgctccggagtggccgtgtgcaaggtcctccaccttgaaggggaagttaacaaaatcaaatcagccctcctctccactaacaaagccgtagtatccctaagcaacggtgtatccgtcctcaccttcaaagtactagacctaaagaattatatcgacaaacaactcctccccatactcaacaaacaatcctgctccataagcaacatcgaaacagtcatcgagttccagcagaaaaacaaccgactcctcgaaataacccgcgagttctcagtcaacgccggagtcaccacacccgtcagcacctacatgctgaccaactccgaactcctctccttaatcaatgacatgcccatcaccaatgaccaaaagaaactcatgtcaaacaacgtccaaatagtacgccaacaatcctactccatcatgtgcatcataaaagaagaagtactcgcctacgtcgtccaactccccctctacggcgtaatcgacaccccctgctggaaactacacacaagccccctctgcaccacaaacactaaagagggctccaacatctgtctaacccgcaccgatcgaggctggtactgcgacaacgccggatctgtctcattcttcccccaagccgaaacctgcaaagtccaatccaaccgcgtcttctgcgacaccatgaactcgagaaccctcccttccgaagtcaacctatgcaacgtcgacattttcaaccccaaatacgactgcaaaatcatgacctcgaaaaccgacgtatcatccagcgtcatcaccagcctaggcgcaatcgtgagctgctacggcaaaaccaaatgcaccgcgagcaataaaaaccgcgggatcatcaaaactttctccaacggctgcgactacgtctccaacaagggagtcgataccgtctccgtaggcaacaccctctactgcgtcaacaaacaagaaggcaaatcactatacgtaaaaggcgagccaatcataaacttctacgaccctctagttttcccatccgacgagttcgacgctagcatctcccaagtcaacgagaaaatcaaccaatccctcgcattcatccgcaaatccgacgaactcctccacaacgtaaacgcaggcaaatcaactactaatataatgatcacaaccatcataatagtcataatcgtaatcctcctatccctcatcgccgtcggactactgctctactgcaaagcccgctaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5230 - RNA, 2136 nt, synthetic construct
  misc_feature 1..2136: note = mRNA product Design g-3 comprising derived and/or modified sequence from HRSV(A2)__F-del_DSCav1_mut4 (opt1)
  source 1..2136: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5231 - RNA, 2136 nt, synthetic construct
  misc_feature 1..2136: note = mRNA product Design g-3 comprising derived and/or modified sequence from HRSV(A2)__F-del_DSCav1_mut4 (opt1)
  source 1..2136: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatctgcagcggcgtggccgtgtgcaaggtcctgcacctcgagggcgaggtgaacaagatcaagtccgcgctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgccggctccgtgagcttcttcccccaggcggagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactgcgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgccttcatccgcaagagcgacgagctgctgcacaacgtgaacgcggggaagtccaccaccaacatcatgatcaccacgatcatcatcgtgatcatcgtcatcctcctgagcctgatcgccgtgggcctcctgctgtactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5232 - RNA, 2136 nt, synthetic construct
  misc_feature 1..2136: note = mRNA product Design g-3 comprising derived and/or modified sequence from HRSV(A2)__F-del_DSCav1_mut4 (opt2)
  source 1..2136: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5233 - RNA, 2136 nt, synthetic construct
  misc_feature 1..2136: note = mRNA product Design g-3 comprising derived and/or modified sequence from HRSV(A2)__F-del_DSCav1_mut4 (opt3)
  source 1..2136: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatatgtagcggagtggcagtctgcaaggtgttgcacctcgagggcgaagttaacaaaatcaagagtgccctgctgtccacgaataaagctgtggtctctctcagcaacggtgtgtccgtattaacttttaaggttctggaccttaagaattacattgataaacaattgctgcctatcctaaacaagcagtcatgtagtattagcaatatcgagaccgtgatagagttccagcagaaaaacaataggctcctggaaattacacgggagttttctgtcaacgccggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgcattataaaggaggaagtgttagcgtatgtagtgcaactgcccctctacggagtcatcgacactccttgttggaaacttcatacaagcccactgtgcaccactaatacaaaggagggctcgaacatttgtttgacccgaacggatcgtggctggtactgcgacaatgcagggtctgtgtccttctttccccaggccgaaacctgtaaggttcagtcaaacagagtgttctgcgatacaatgaatagtagaactctgcctagcgaggtcaacctctgcaatgtggacatctttaacccaaaatatgattgtaagataatgacctccaaaacagacgtatctagctcagttattaccagtctgggagctatcgtgtcctgctacggtaagactaaatgtacagccagcaataagaacaggggcatcattaagaccttctctaatgggtgcgattatgtctcaaacaaaggagtggacactgtcagtgtgggcaatacgctttactgtgttaacaagcaagagggtaaaagcctgtatgtgaagggggaacccatcattaacttttacgaccctttggtattcccatccgatgagtttgacgcatctatatcgcaggtcaatgagaaaatcaaccagagcctcgctttcattcggaagtccgatgaactgttacacaatgtgaacgccggaaagtcaacaaccaatatcatgatcactaccattataatcgttattatcgtgattctgctaagtctcatcgcggtcggcctgcttttgtattgcaaagcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5234 - RNA, 2136 nt, synthetic construct
  misc_feature 1..2136: note = mRNA product Design g-3 comprising derived and/or modified sequence from HRSV(A2)__F-del_DSCav1_mut4 (opt4)
  source 1..2136: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5235 - RNA, 2136 nt, synthetic construct
  misc_feature 1..2136: note = mRNA product Design g-3 comprising derived and/or modified sequence from HRSV(A2)__F-del_DSCav1_mut4 (opt5)
  source 1..2136: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctatttgttccggcgtcgccgtgtgcaaggttctccacctggagggggaagtgaacaaaatcaagagcgcgcttctgtctaccaataaagccgtcgtgtccctcagcaacggagtttctgtgctgacatttaaggtccttgacctgaagaattacattgataaacaactcctgcctatcctgaacaagcagtcctgtagcatttctaatatcgagaccgtgattgagttccagcagaaaaacaatcggctcctggaaatcacgcgcgagttttccgtgaacgctggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgcatcattaaggaggaagtcctggcctatgtggttcaactccctctgtacggcgtgatcgacacaccctgttggaaactgcatacgtctcctctctgcaccacaaataccaaggaggggtccaacatctgtctgacacggaccgatcgcggatggtactgcgacaatgctggcagcgtctctttctttccccaggccgaaacgtgtaaggtgcagagcaacagagttttctgcgatacaatgaactccagaaccctgccttctgaggtgaatctctgcaatgtcgacatttttaacccgaaatatgattgtaagatcatgaccagcaaaacagacgtgtccagctctgtcattacctccctgggggcgatcgtgagctgctacggaaagacaaaatgtacggcctctaataagaaccggggcattatcaagaccttctccaatgggtgcgattatgttagcaacaaaggagtggacacagtctccgtgggcaataccctttactgtgttaacaagcaagagggcaaatctctgtatgtgaagggggaacccatcattaacttttacgaccctctcgtcttccccagcgatgagtttgacgcttccatctctcaggtgaatgagaaaattaaccagagcctggccttcatccgcaagtccgatgaactgctccacaatgtgaacgctggaaagagcacaaccaatattatgatcacgaccattatcatcgttattatcgtcattctgctttctctgatcgccgtgggcctcctgctgtattgcaaagccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5236 - RNA, 2136 nt, synthetic construct
  misc_feature 1..2136: note = mRNA product Design g-3 comprising derived and/or modified sequence from HRSV(A2)__F-del_DSCav1_mut4 (opt6)
  source 1..2136: mol_type = other RNA
gggagagtccgctcagccaggttgcagaagcggcttagcgtgtgtcctaatcttctctctgcgtgtaggtaggcctgtgccgcaaacaagcttaccatggaacttttaatactaaaagctaacgccataaccactatactaacagcagtcacattctgcttcgcatcaggccaaaacataaccgaagaattttaccaatccacttgttcagcagtctccaaaggatatttatccgcacttcgtacaggatggtatacatcagtaataacaatagaactctccaacataaaagaaaataaatgcaacggcaccgacgcaaaagtaaaactcatcaaacaagaattagacaaatacaagaacgccgtaacagaactacaattactaatgcaatcaacacccgccacaggatcaggatctgcaatatgctctggagtagcagtatgcaaagtattacacctagaaggagaagtaaacaaaatcaaaagcgcactactatccacaaacaaagctgtagtatcactatcaaacggagtatcagtattaactttcaaagtacttgatctaaaaaactacatagacaaacaactactacccatattaaacaaacaatcatgctcaataagcaatatagaaacagtaatagaatttcaacaaaaaaacaacagactactagaaatcacaagggaattttcagtaaatgccggtgttacaaccccagtatcaacatacatgctaactaactcagaactactatccttaataaacgatatgccaataacaaacgatcaaaaaaaactaatgtccaacaacgtacaaatagtaagacaacaatcatactcaatcatgtgcattataaaagaagaagtcttagcatacgtagtacaattaccactatacggtgtaatagatacaccatgttggaaattacacacaagcccactatgcacaactaacacaaaagaaggctcaaatatatgtttaacaagaacagaccgaggttggtactgcgacaatgcaggatcagtatcattctttccacaagcagaaacatgtaaagttcaatccaacagagtattctgcgacacaatgaactccagaacactaccttcagaagtaaacctctgtaacgtagacatatttaatcccaagtacgactgcaaaataatgacatcgaaaacagacgtaagctcctcagtgataacatccctcggcgccatcgtatcctgttacggtaaaactaaatgtaccgcctcaaacaaaaaccgcggtattataaaaactttttctaatggctgcgattacgtaagcaacaaaggcgtcgacacagtttccgtaggaaacacactatactgcgtaaacaaacaagaaggtaaatctctatacgtaaaaggagaaccaataataaatttctatgatcctttagtattcccatccgatgaatttgacgcctctatctcacaagtcaacgaaaaaataaatcaatcattagcattcatacgaaaatcagacgaactactacacaacgtaaacgcaggaaaatcaacaaccaacataatgataaccacaataataatagttattatagtgatactattatccttaattgcagtcggactattattatactgtaaagcacgctaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5237 - RNA, 2136 nt, synthetic construct
  misc_feature 1..2136: note = mRNA product Design g-3 comprising derived and/or modified sequence from HRSV(A2)__F-del_DSCav1_mut4 (opt11)
  source 1..2136: mol_type = other RNA
gggagagtccgctcagccaggttgcagaagcggcttagcgtgtgtcctaatcttctctctgcgtgtaggtaggcctgtgccgcaaacaagcttaccatggaactcctcatcctcaaagccaatgccatcaccacaatcctgacagcagtaaccttctgcttcgcatccggacaaaacatcaccgaagaattttaccagtcaacctgctccgctgtctcaaaaggctacctctcagcccttcgcaccggctggtacacctcggtcataacaatagaactctccaatatcaaagaaaacaaatgcaacggcactgacgccaaggtaaaactcatcaaacaggaactcgataaatacaagaacgccgtaacagaactacaactactcatgcaatcaacaccggccaccggctccggttccgccatatgctccggagtggccgtgtgcaaggtcctccaccttgaaggggaagttaacaaaatcaaatcagccctcctctccactaacaaagccgtagtatccctaagcaacggtgtatccgtcctcaccttcaaagtactagacctaaagaattatatcgacaaacaactcctccccatactcaacaaacaatcctgctccataagcaacatcgaaacagtcatcgagttccagcagaaaaacaaccgactcctcgaaataacccgcgagttctcagtcaacgccggagtcaccacacccgtcagcacctacatgctgaccaactccgaactcctctccttaatcaatgacatgcccatcaccaatgaccaaaagaaactcatgtcaaacaacgtccaaatagtacgccaacaatcctactccatcatgtgcatcataaaagaagaagtactcgcctacgtcgtccaactccccctctacggcgtaatcgacaccccctgctggaaactacacacaagccccctctgcaccacaaacactaaagagggctccaacatctgtctaacccgcaccgatcgaggctggtactgcgacaacgccggatctgtctcattcttcccccaagccgaaacctgcaaagtccaatccaaccgcgtcttctgcgacaccatgaactcgagaaccctcccttccgaagtcaacctatgcaacgtcgacattttcaaccccaaatacgactgcaaaatcatgacctcgaaaaccgacgtatcatccagcgtcatcaccagcctaggcgcaatcgtgagctgctacggcaaaaccaaatgcaccgcgagcaataaaaaccgcgggatcatcaaaactttctccaacggctgcgactacgtctccaacaagggagtcgataccgtctccgtaggcaacaccctctactgcgtcaacaaacaagaaggcaaatcactatacgtaaaaggcgagccaatcataaacttctacgaccctctagttttcccatccgacgagttcgacgctagcatctcccaagtcaacgagaaaatcaaccaatccctcgcattcatccgcaaatccgacgaactcctccacaacgtaaacgcaggcaaatcaactactaatataatgatcacaaccatcataatagtcataatcgtaatcctcctatccctcatcgccgtcggactactgctctactgcaaagcccgctaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5238 - RNA, 1931 nt, synthetic construct
  misc_feature 1..1931: note = mRNA product Design g-4 comprising derived and/or modified sequence from HRSV(A2)__F-del_DSCav1_mut4 (opt1)
  source 1..1931: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5239 - RNA, 1931 nt, synthetic construct
  misc_feature 1..1931: note = mRNA product Design g-4 comprising derived and/or modified sequence from HRSV(A2)__F-del_DSCav1_mut4 (opt1)
  source 1..1931: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatctgcagcggcgtggccgtgtgcaaggtcctgcacctcgagggcgaggtgaacaagatcaagtccgcgctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgccggctccgtgagcttcttcccccaggcggagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactgcgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgccttcatccgcaagagcgacgagctgctgcacaacgtgaacgcggggaagtccaccaccaacatcatgatcaccacgatcatcatcgtgatcatcgtcatcctcctgagcctgatcgccgtgggcctcctgctgtactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5240 - RNA, 1931 nt, synthetic construct
  misc_feature 1..1931: note = mRNA product Design g-4 comprising derived and/or modified sequence from HRSV(A2)__F-del_DSCav1_mut4 (opt2)
  source 1..1931: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5241 - RNA, 1931 nt, synthetic construct
  misc_feature 1..1931: note = mRNA product Design g-4 comprising derived and/or modified sequence from HRSV(A2)__F-del_DSCav1_mut4 (opt3)
  source 1..1931: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatatgtagcggagtggcagtctgcaaggtgttgcacctcgagggcgaagttaacaaaatcaagagtgccctgctgtccacgaataaagctgtggtctctctcagcaacggtgtgtccgtattaacttttaaggttctggaccttaagaattacattgataaacaattgctgcctatcctaaacaagcagtcatgtagtattagcaatatcgagaccgtgatagagttccagcagaaaaacaataggctcctggaaattacacgggagttttctgtcaacgccggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgcattataaaggaggaagtgttagcgtatgtagtgcaactgcccctctacggagtcatcgacactccttgttggaaacttcatacaagcccactgtgcaccactaatacaaaggagggctcgaacatttgtttgacccgaacggatcgtggctggtactgcgacaatgcagggtctgtgtccttctttccccaggccgaaacctgtaaggttcagtcaaacagagtgttctgcgatacaatgaatagtagaactctgcctagcgaggtcaacctctgcaatgtggacatctttaacccaaaatatgattgtaagataatgacctccaaaacagacgtatctagctcagttattaccagtctgggagctatcgtgtcctgctacggtaagactaaatgtacagccagcaataagaacaggggcatcattaagaccttctctaatgggtgcgattatgtctcaaacaaaggagtggacactgtcagtgtgggcaatacgctttactgtgttaacaagcaagagggtaaaagcctgtatgtgaagggggaacccatcattaacttttacgaccctttggtattcccatccgatgagtttgacgcatctatatcgcaggtcaatgagaaaatcaaccagagcctcgctttcattcggaagtccgatgaactgttacacaatgtgaacgccggaaagtcaacaaccaatatcatgatcactaccattataatcgttattatcgtgattctgctaagtctcatcgcggtcggcctgcttttgtattgcaaagcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5242 - RNA, 1931 nt, synthetic construct
  misc_feature 1..1931: note = mRNA product Design g-4 comprising derived and/or modified sequence from HRSV(A2)__F-del_DSCav1_mut4 (opt4)
  source 1..1931: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5243 - RNA, 1931 nt, synthetic construct
  misc_feature 1..1931: note = mRNA product Design g-4 comprising derived and/or modified sequence from HRSV(A2)__F-del_DSCav1_mut4 (opt5)
  source 1..1931: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctatttgttccggcgtcgccgtgtgcaaggttctccacctggagggggaagtgaacaaaatcaagagcgcgcttctgtctaccaataaagccgtcgtgtccctcagcaacggagtttctgtgctgacatttaaggtccttgacctgaagaattacattgataaacaactcctgcctatcctgaacaagcagtcctgtagcatttctaatatcgagaccgtgattgagttccagcagaaaaacaatcggctcctggaaatcacgcgcgagttttccgtgaacgctggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgcatcattaaggaggaagtcctggcctatgtggttcaactccctctgtacggcgtgatcgacacaccctgttggaaactgcatacgtctcctctctgcaccacaaataccaaggaggggtccaacatctgtctgacacggaccgatcgcggatggtactgcgacaatgctggcagcgtctctttctttccccaggccgaaacgtgtaaggtgcagagcaacagagttttctgcgatacaatgaactccagaaccctgccttctgaggtgaatctctgcaatgtcgacatttttaacccgaaatatgattgtaagatcatgaccagcaaaacagacgtgtccagctctgtcattacctccctgggggcgatcgtgagctgctacggaaagacaaaatgtacggcctctaataagaaccggggcattatcaagaccttctccaatgggtgcgattatgttagcaacaaaggagtggacacagtctccgtgggcaataccctttactgtgttaacaagcaagagggcaaatctctgtatgtgaagggggaacccatcattaacttttacgaccctctcgtcttccccagcgatgagtttgacgcttccatctctcaggtgaatgagaaaattaaccagagcctggccttcatccgcaagtccgatgaactgctccacaatgtgaacgctggaaagagcacaaccaatattatgatcacgaccattatcatcgttattatcgtcattctgctttctctgatcgccgtgggcctcctgctgtattgcaaagccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5244 - RNA, 1931 nt, synthetic construct
  misc_feature 1..1931: note = mRNA product Design g-4 comprising derived and/or modified sequence from HRSV(A2)__F-del_DSCav1_mut4 (opt6)
  source 1..1931: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaacttttaatactaaaagctaacgccataaccactatactaacagcagtcacattctgcttcgcatcaggccaaaacataaccgaagaattttaccaatccacttgttcagcagtctccaaaggatatttatccgcacttcgtacaggatggtatacatcagtaataacaatagaactctccaacataaaagaaaataaatgcaacggcaccgacgcaaaagtaaaactcatcaaacaagaattagacaaatacaagaacgccgtaacagaactacaattactaatgcaatcaacacccgccacaggatcaggatctgcaatatgctctggagtagcagtatgcaaagtattacacctagaaggagaagtaaacaaaatcaaaagcgcactactatccacaaacaaagctgtagtatcactatcaaacggagtatcagtattaactttcaaagtacttgatctaaaaaactacatagacaaacaactactacccatattaaacaaacaatcatgctcaataagcaatatagaaacagtaatagaatttcaacaaaaaaacaacagactactagaaatcacaagggaattttcagtaaatgccggtgttacaaccccagtatcaacatacatgctaactaactcagaactactatccttaataaacgatatgccaataacaaacgatcaaaaaaaactaatgtccaacaacgtacaaatagtaagacaacaatcatactcaatcatgtgcattataaaagaagaagtcttagcatacgtagtacaattaccactatacggtgtaatagatacaccatgttggaaattacacacaagcccactatgcacaactaacacaaaagaaggctcaaatatatgtttaacaagaacagaccgaggttggtactgcgacaatgcaggatcagtatcattctttccacaagcagaaacatgtaaagttcaatccaacagagtattctgcgacacaatgaactccagaacactaccttcagaagtaaacctctgtaacgtagacatatttaatcccaagtacgactgcaaaataatgacatcgaaaacagacgtaagctcctcagtgataacatccctcggcgccatcgtatcctgttacggtaaaactaaatgtaccgcctcaaacaaaaaccgcggtattataaaaactttttctaatggctgcgattacgtaagcaacaaaggcgtcgacacagtttccgtaggaaacacactatactgcgtaaacaaacaagaaggtaaatctctatacgtaaaaggagaaccaataataaatttctatgatcctttagtattcccatccgatgaatttgacgcctctatctcacaagtcaacgaaaaaataaatcaatcattagcattcatacgaaaatcagacgaactactacacaacgtaaacgcaggaaaatcaacaaccaacataatgataaccacaataataatagttattatagtgatactattatccttaattgcagtcggactattattatactgtaaagcacgctaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5245 - RNA, 1931 nt, synthetic construct
  misc_feature 1..1931: note = mRNA product Design g-4 comprising derived and/or modified sequence from HRSV(A2)__F-del_DSCav1_mut4 (opt11)
  source 1..1931: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactcctcatcctcaaagccaatgccatcaccacaatcctgacagcagtaaccttctgcttcgcatccggacaaaacatcaccgaagaattttaccagtcaacctgctccgctgtctcaaaaggctacctctcagcccttcgcaccggctggtacacctcggtcataacaatagaactctccaatatcaaagaaaacaaatgcaacggcactgacgccaaggtaaaactcatcaaacaggaactcgataaatacaagaacgccgtaacagaactacaactactcatgcaatcaacaccggccaccggctccggttccgccatatgctccggagtggccgtgtgcaaggtcctccaccttgaaggggaagttaacaaaatcaaatcagccctcctctccactaacaaagccgtagtatccctaagcaacggtgtatccgtcctcaccttcaaagtactagacctaaagaattatatcgacaaacaactcctccccatactcaacaaacaatcctgctccataagcaacatcgaaacagtcatcgagttccagcagaaaaacaaccgactcctcgaaataacccgcgagttctcagtcaacgccggagtcaccacacccgtcagcacctacatgctgaccaactccgaactcctctccttaatcaatgacatgcccatcaccaatgaccaaaagaaactcatgtcaaacaacgtccaaatagtacgccaacaatcctactccatcatgtgcatcataaaagaagaagtactcgcctacgtcgtccaactccccctctacggcgtaatcgacaccccctgctggaaactacacacaagccccctctgcaccacaaacactaaagagggctccaacatctgtctaacccgcaccgatcgaggctggtactgcgacaacgccggatctgtctcattcttcccccaagccgaaacctgcaaagtccaatccaaccgcgtcttctgcgacaccatgaactcgagaaccctcccttccgaagtcaacctatgcaacgtcgacattttcaaccccaaatacgactgcaaaatcatgacctcgaaaaccgacgtatcatccagcgtcatcaccagcctaggcgcaatcgtgagctgctacggcaaaaccaaatgcaccgcgagcaataaaaaccgcgggatcatcaaaactttctccaacggctgcgactacgtctccaacaagggagtcgataccgtctccgtaggcaacaccctctactgcgtcaacaaacaagaaggcaaatcactatacgtaaaaggcgagccaatcataaacttctacgaccctctagttttcccatccgacgagttcgacgctagcatctcccaagtcaacgagaaaatcaaccaatccctcgcattcatccgcaaatccgacgaactcctccacaacgtaaacgcaggcaaatcaactactaatataatgatcacaaccatcataatagtcataatcgtaatcctcctatccctcatcgccgtcggactactgctctactgcaaagcccgctaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5246 - RNA, 1907 nt, synthetic construct
  misc_feature 1..1907: note = mRNA product Design g-5 comprising derived and/or modified sequence from HRSV(A2)__F-del_DSCav1_mut4 (opt1)
  source 1..1907: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5247 - RNA, 1907 nt, synthetic construct
  misc_feature 1..1907: note = mRNA product Design g-5 comprising derived and/or modified sequence from HRSV(A2)__F-del_DSCav1_mut4 (opt1)
  source 1..1907: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatctgcagcggcgtggccgtgtgcaaggtcctgcacctcgagggcgaggtgaacaagatcaagtccgcgctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgccggctccgtgagcttcttcccccaggcggagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactgcgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgccttcatccgcaagagcgacgagctgctgcacaacgtgaacgcggggaagtccaccaccaacatcatgatcaccacgatcatcatcgtgatcatcgtcatcctcctgagcctgatcgccgtgggcctcctgctgtactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5248 - RNA, 1907 nt, synthetic construct
  misc_feature 1..1907: note = mRNA product Design g-5 comprising derived and/or modified sequence from HRSV(A2)__F-del_DSCav1_mut4 (opt2)
  source 1..1907: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5249 - RNA, 1907 nt, synthetic construct
  misc_feature 1..1907: note = mRNA product Design g-5 comprising derived and/or modified sequence from HRSV(A2)__F-del_DSCav1_mut4 (opt3)
  source 1..1907: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatatgtagcggagtggcagtctgcaaggtgttgcacctcgagggcgaagttaacaaaatcaagagtgccctgctgtccacgaataaagctgtggtctctctcagcaacggtgtgtccgtattaacttttaaggttctggaccttaagaattacattgataaacaattgctgcctatcctaaacaagcagtcatgtagtattagcaatatcgagaccgtgatagagttccagcagaaaaacaataggctcctggaaattacacgggagttttctgtcaacgccggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgcattataaaggaggaagtgttagcgtatgtagtgcaactgcccctctacggagtcatcgacactccttgttggaaacttcatacaagcccactgtgcaccactaatacaaaggagggctcgaacatttgtttgacccgaacggatcgtggctggtactgcgacaatgcagggtctgtgtccttctttccccaggccgaaacctgtaaggttcagtcaaacagagtgttctgcgatacaatgaatagtagaactctgcctagcgaggtcaacctctgcaatgtggacatctttaacccaaaatatgattgtaagataatgacctccaaaacagacgtatctagctcagttattaccagtctgggagctatcgtgtcctgctacggtaagactaaatgtacagccagcaataagaacaggggcatcattaagaccttctctaatgggtgcgattatgtctcaaacaaaggagtggacactgtcagtgtgggcaatacgctttactgtgttaacaagcaagagggtaaaagcctgtatgtgaagggggaacccatcattaacttttacgaccctttggtattcccatccgatgagtttgacgcatctatatcgcaggtcaatgagaaaatcaaccagagcctcgctttcattcggaagtccgatgaactgttacacaatgtgaacgccggaaagtcaacaaccaatatcatgatcactaccattataatcgttattatcgtgattctgctaagtctcatcgcggtcggcctgcttttgtattgcaaagcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5250 - RNA, 1907 nt, synthetic construct
  misc_feature 1..1907: note = mRNA product Design g-5 comprising derived and/or modified sequence from HRSV(A2)__F-del_DSCav1_mut4 (opt4)
  source 1..1907: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5251 - RNA, 1907 nt, synthetic construct
  misc_feature 1..1907: note = mRNA product Design g-5 comprising derived and/or modified sequence from HRSV(A2)__F-del_DSCav1_mut4 (opt5)
  source 1..1907: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctatttgttccggcgtcgccgtgtgcaaggttctccacctggagggggaagtgaacaaaatcaagagcgcgcttctgtctaccaataaagccgtcgtgtccctcagcaacggagtttctgtgctgacatttaaggtccttgacctgaagaattacattgataaacaactcctgcctatcctgaacaagcagtcctgtagcatttctaatatcgagaccgtgattgagttccagcagaaaaacaatcggctcctggaaatcacgcgcgagttttccgtgaacgctggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgcatcattaaggaggaagtcctggcctatgtggttcaactccctctgtacggcgtgatcgacacaccctgttggaaactgcatacgtctcctctctgcaccacaaataccaaggaggggtccaacatctgtctgacacggaccgatcgcggatggtactgcgacaatgctggcagcgtctctttctttccccaggccgaaacgtgtaaggtgcagagcaacagagttttctgcgatacaatgaactccagaaccctgccttctgaggtgaatctctgcaatgtcgacatttttaacccgaaatatgattgtaagatcatgaccagcaaaacagacgtgtccagctctgtcattacctccctgggggcgatcgtgagctgctacggaaagacaaaatgtacggcctctaataagaaccggggcattatcaagaccttctccaatgggtgcgattatgttagcaacaaaggagtggacacagtctccgtgggcaataccctttactgtgttaacaagcaagagggcaaatctctgtatgtgaagggggaacccatcattaacttttacgaccctctcgtcttccccagcgatgagtttgacgcttccatctctcaggtgaatgagaaaattaaccagagcctggccttcatccgcaagtccgatgaactgctccacaatgtgaacgctggaaagagcacaaccaatattatgatcacgaccattatcatcgttattatcgtcattctgctttctctgatcgccgtgggcctcctgctgtattgcaaagccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5252 - RNA, 1907 nt, synthetic construct
  misc_feature 1..1907: note = mRNA product Design g-5 comprising derived and/or modified sequence from HRSV(A2)__F-del_DSCav1_mut4 (opt6)
  source 1..1907: mol_type = other RNA
gggagacccgtgacccggaagttgtacggctacgcgactttccctcccacaaaccctcgcgcccttcctttcctacttgggcccggcagaaagcttaccatggaacttttaatactaaaagctaacgccataaccactatactaacagcagtcacattctgcttcgcatcaggccaaaacataaccgaagaattttaccaatccacttgttcagcagtctccaaaggatatttatccgcacttcgtacaggatggtatacatcagtaataacaatagaactctccaacataaaagaaaataaatgcaacggcaccgacgcaaaagtaaaactcatcaaacaagaattagacaaatacaagaacgccgtaacagaactacaattactaatgcaatcaacacccgccacaggatcaggatctgcaatatgctctggagtagcagtatgcaaagtattacacctagaaggagaagtaaacaaaatcaaaagcgcactactatccacaaacaaagctgtagtatcactatcaaacggagtatcagtattaactttcaaagtacttgatctaaaaaactacatagacaaacaactactacccatattaaacaaacaatcatgctcaataagcaatatagaaacagtaatagaatttcaacaaaaaaacaacagactactagaaatcacaagggaattttcagtaaatgccggtgttacaaccccagtatcaacatacatgctaactaactcagaactactatccttaataaacgatatgccaataacaaacgatcaaaaaaaactaatgtccaacaacgtacaaatagtaagacaacaatcatactcaatcatgtgcattataaaagaagaagtcttagcatacgtagtacaattaccactatacggtgtaatagatacaccatgttggaaattacacacaagcccactatgcacaactaacacaaaagaaggctcaaatatatgtttaacaagaacagaccgaggttggtactgcgacaatgcaggatcagtatcattctttccacaagcagaaacatgtaaagttcaatccaacagagtattctgcgacacaatgaactccagaacactaccttcagaagtaaacctctgtaacgtagacatatttaatcccaagtacgactgcaaaataatgacatcgaaaacagacgtaagctcctcagtgataacatccctcggcgccatcgtatcctgttacggtaaaactaaatgtaccgcctcaaacaaaaaccgcggtattataaaaactttttctaatggctgcgattacgtaagcaacaaaggcgtcgacacagtttccgtaggaaacacactatactgcgtaaacaaacaagaaggtaaatctctatacgtaaaaggagaaccaataataaatttctatgatcctttagtattcccatccgatgaatttgacgcctctatctcacaagtcaacgaaaaaataaatcaatcattagcattcatacgaaaatcagacgaactactacacaacgtaaacgcaggaaaatcaacaaccaacataatgataaccacaataataatagttattatagtgatactattatccttaattgcagtcggactattattatactgtaaagcacgctaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5253 - RNA, 1907 nt, synthetic construct
  misc_feature 1..1907: note = mRNA product Design g-5 comprising derived and/or modified sequence from HRSV(A2)__F-del_DSCav1_mut4 (opt11)
  source 1..1907: mol_type = other RNA
gggagacccgtgacccggaagttgtacggctacgcgactttccctcccacaaaccctcgcgcccttcctttcctacttgggcccggcagaaagcttaccatggaactcctcatcctcaaagccaatgccatcaccacaatcctgacagcagtaaccttctgcttcgcatccggacaaaacatcaccgaagaattttaccagtcaacctgctccgctgtctcaaaaggctacctctcagcccttcgcaccggctggtacacctcggtcataacaatagaactctccaatatcaaagaaaacaaatgcaacggcactgacgccaaggtaaaactcatcaaacaggaactcgataaatacaagaacgccgtaacagaactacaactactcatgcaatcaacaccggccaccggctccggttccgccatatgctccggagtggccgtgtgcaaggtcctccaccttgaaggggaagttaacaaaatcaaatcagccctcctctccactaacaaagccgtagtatccctaagcaacggtgtatccgtcctcaccttcaaagtactagacctaaagaattatatcgacaaacaactcctccccatactcaacaaacaatcctgctccataagcaacatcgaaacagtcatcgagttccagcagaaaaacaaccgactcctcgaaataacccgcgagttctcagtcaacgccggagtcaccacacccgtcagcacctacatgctgaccaactccgaactcctctccttaatcaatgacatgcccatcaccaatgaccaaaagaaactcatgtcaaacaacgtccaaatagtacgccaacaatcctactccatcatgtgcatcataaaagaagaagtactcgcctacgtcgtccaactccccctctacggcgtaatcgacaccccctgctggaaactacacacaagccccctctgcaccacaaacactaaagagggctccaacatctgtctaacccgcaccgatcgaggctggtactgcgacaacgccggatctgtctcattcttcccccaagccgaaacctgcaaagtccaatccaaccgcgtcttctgcgacaccatgaactcgagaaccctcccttccgaagtcaacctatgcaacgtcgacattttcaaccccaaatacgactgcaaaatcatgacctcgaaaaccgacgtatcatccagcgtcatcaccagcctaggcgcaatcgtgagctgctacggcaaaaccaaatgcaccgcgagcaataaaaaccgcgggatcatcaaaactttctccaacggctgcgactacgtctccaacaagggagtcgataccgtctccgtaggcaacaccctctactgcgtcaacaaacaagaaggcaaatcactatacgtaaaaggcgagccaatcataaacttctacgaccctctagttttcccatccgacgagttcgacgctagcatctcccaagtcaacgagaaaatcaaccaatccctcgcattcatccgcaaatccgacgaactcctccacaacgtaaacgcaggcaaatcaactactaatataatgatcacaaccatcataatagtcataatcgtaatcctcctatccctcatcgccgtcggactactgctctactgcaaagcccgctaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5254 - RNA, 1923 nt, synthetic construct
  misc_feature 1..1923: note = mRNA product Design h-1 comprising derived and/or modified sequence from HRSV(A2)__F-del_DSCav1_mut4 (opt1)
  source 1..1923: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5255 - RNA, 1923 nt, synthetic construct
  misc_feature 1..1923: note = mRNA product Design h-1 comprising derived and/or modified sequence from HRSV(A2)__F-del_DSCav1_mut4 (opt1)
  source 1..1923: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatctgcagcggcgtggccgtgtgcaaggtcctgcacctcgagggcgaggtgaacaagatcaagtccgcgctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgccggctccgtgagcttcttcccccaggcggagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactgcgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgccttcatccgcaagagcgacgagctgctgcacaacgtgaacgcggggaagtccaccaccaacatcatgatcaccacgatcatcatcgtgatcatcgtcatcctcctgagcctgatcgccgtgggcctcctgctgtactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5256 - RNA, 1923 nt, synthetic construct
  misc_feature 1..1923: note = mRNA product Design h-1 comprising derived and/or modified sequence from HRSV(A2)__F-del_DSCav1_mut4 (opt2)
  source 1..1923: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5257 - RNA, 1923 nt, synthetic construct
  misc_feature 1..1923: note = mRNA product Design h-1 comprising derived and/or modified sequence from HRSV(A2)__F-del_DSCav1_mut4 (opt3)
  source 1..1923: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatatgtagcggagtggcagtctgcaaggtgttgcacctcgagggcgaagttaacaaaatcaagagtgccctgctgtccacgaataaagctgtggtctctctcagcaacggtgtgtccgtattaacttttaaggttctggaccttaagaattacattgataaacaattgctgcctatcctaaacaagcagtcatgtagtattagcaatatcgagaccgtgatagagttccagcagaaaaacaataggctcctggaaattacacgggagttttctgtcaacgccggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgcattataaaggaggaagtgttagcgtatgtagtgcaactgcccctctacggagtcatcgacactccttgttggaaacttcatacaagcccactgtgcaccactaatacaaaggagggctcgaacatttgtttgacccgaacggatcgtggctggtactgcgacaatgcagggtctgtgtccttctttccccaggccgaaacctgtaaggttcagtcaaacagagtgttctgcgatacaatgaatagtagaactctgcctagcgaggtcaacctctgcaatgtggacatctttaacccaaaatatgattgtaagataatgacctccaaaacagacgtatctagctcagttattaccagtctgggagctatcgtgtcctgctacggtaagactaaatgtacagccagcaataagaacaggggcatcattaagaccttctctaatgggtgcgattatgtctcaaacaaaggagtggacactgtcagtgtgggcaatacgctttactgtgttaacaagcaagagggtaaaagcctgtatgtgaagggggaacccatcattaacttttacgaccctttggtattcccatccgatgagtttgacgcatctatatcgcaggtcaatgagaaaatcaaccagagcctcgctttcattcggaagtccgatgaactgttacacaatgtgaacgccggaaagtcaacaaccaatatcatgatcactaccattataatcgttattatcgtgattctgctaagtctcatcgcggtcggcctgcttttgtattgcaaagcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5258 - RNA, 1923 nt, synthetic construct
  misc_feature 1..1923: note = mRNA product Design h-1 comprising derived and/or modified sequence from HRSV(A2)__F-del_DSCav1_mut4 (opt4)
  source 1..1923: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5259 - RNA, 1923 nt, synthetic construct
  misc_feature 1..1923: note = mRNA product Design h-1 comprising derived and/or modified sequence from HRSV(A2)__F-del_DSCav1_mut4 (opt5)
  source 1..1923: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctatttgttccggcgtcgccgtgtgcaaggttctccacctggagggggaagtgaacaaaatcaagagcgcgcttctgtctaccaataaagccgtcgtgtccctcagcaacggagtttctgtgctgacatttaaggtccttgacctgaagaattacattgataaacaactcctgcctatcctgaacaagcagtcctgtagcatttctaatatcgagaccgtgattgagttccagcagaaaaacaatcggctcctggaaatcacgcgcgagttttccgtgaacgctggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgcatcattaaggaggaagtcctggcctatgtggttcaactccctctgtacggcgtgatcgacacaccctgttggaaactgcatacgtctcctctctgcaccacaaataccaaggaggggtccaacatctgtctgacacggaccgatcgcggatggtactgcgacaatgctggcagcgtctctttctttccccaggccgaaacgtgtaaggtgcagagcaacagagttttctgcgatacaatgaactccagaaccctgccttctgaggtgaatctctgcaatgtcgacatttttaacccgaaatatgattgtaagatcatgaccagcaaaacagacgtgtccagctctgtcattacctccctgggggcgatcgtgagctgctacggaaagacaaaatgtacggcctctaataagaaccggggcattatcaagaccttctccaatgggtgcgattatgttagcaacaaaggagtggacacagtctccgtgggcaataccctttactgtgttaacaagcaagagggcaaatctctgtatgtgaagggggaacccatcattaacttttacgaccctctcgtcttccccagcgatgagtttgacgcttccatctctcaggtgaatgagaaaattaaccagagcctggccttcatccgcaagtccgatgaactgctccacaatgtgaacgctggaaagagcacaaccaatattatgatcacgaccattatcatcgttattatcgtcattctgctttctctgatcgccgtgggcctcctgctgtattgcaaagccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5260 - RNA, 1923 nt, synthetic construct
  misc_feature 1..1923: note = mRNA product Design h-1 comprising derived and/or modified sequence from HRSV(A2)__F-del_DSCav1_mut4 (opt6)
  source 1..1923: mol_type = other RNA
gggagacccgtgacccggaagttgtacggctacgcgactttccctcccacaaaccctcgcgcccttcctttcctacttgggcccggcagaaagcttaccatggaacttttaatactaaaagctaacgccataaccactatactaacagcagtcacattctgcttcgcatcaggccaaaacataaccgaagaattttaccaatccacttgttcagcagtctccaaaggatatttatccgcacttcgtacaggatggtatacatcagtaataacaatagaactctccaacataaaagaaaataaatgcaacggcaccgacgcaaaagtaaaactcatcaaacaagaattagacaaatacaagaacgccgtaacagaactacaattactaatgcaatcaacacccgccacaggatcaggatctgcaatatgctctggagtagcagtatgcaaagtattacacctagaaggagaagtaaacaaaatcaaaagcgcactactatccacaaacaaagctgtagtatcactatcaaacggagtatcagtattaactttcaaagtacttgatctaaaaaactacatagacaaacaactactacccatattaaacaaacaatcatgctcaataagcaatatagaaacagtaatagaatttcaacaaaaaaacaacagactactagaaatcacaagggaattttcagtaaatgccggtgttacaaccccagtatcaacatacatgctaactaactcagaactactatccttaataaacgatatgccaataacaaacgatcaaaaaaaactaatgtccaacaacgtacaaatagtaagacaacaatcatactcaatcatgtgcattataaaagaagaagtcttagcatacgtagtacaattaccactatacggtgtaatagatacaccatgttggaaattacacacaagcccactatgcacaactaacacaaaagaaggctcaaatatatgtttaacaagaacagaccgaggttggtactgcgacaatgcaggatcagtatcattctttccacaagcagaaacatgtaaagttcaatccaacagagtattctgcgacacaatgaactccagaacactaccttcagaagtaaacctctgtaacgtagacatatttaatcccaagtacgactgcaaaataatgacatcgaaaacagacgtaagctcctcagtgataacatccctcggcgccatcgtatcctgttacggtaaaactaaatgtaccgcctcaaacaaaaaccgcggtattataaaaactttttctaatggctgcgattacgtaagcaacaaaggcgtcgacacagtttccgtaggaaacacactatactgcgtaaacaaacaagaaggtaaatctctatacgtaaaaggagaaccaataataaatttctatgatcctttagtattcccatccgatgaatttgacgcctctatctcacaagtcaacgaaaaaataaatcaatcattagcattcatacgaaaatcagacgaactactacacaacgtaaacgcaggaaaatcaacaaccaacataatgataaccacaataataatagttattatagtgatactattatccttaattgcagtcggactattattatactgtaaagcacgctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5261 - RNA, 1923 nt, synthetic construct
  misc_feature 1..1923: note = mRNA product Design h-1 comprising derived and/or modified sequence from HRSV(A2)__F-del_DSCav1_mut4 (opt11)
  source 1..1923: mol_type = other RNA
gggagacccgtgacccggaagttgtacggctacgcgactttccctcccacaaaccctcgcgcccttcctttcctacttgggcccggcagaaagcttaccatggaactcctcatcctcaaagccaatgccatcaccacaatcctgacagcagtaaccttctgcttcgcatccggacaaaacatcaccgaagaattttaccagtcaacctgctccgctgtctcaaaaggctacctctcagcccttcgcaccggctggtacacctcggtcataacaatagaactctccaatatcaaagaaaacaaatgcaacggcactgacgccaaggtaaaactcatcaaacaggaactcgataaatacaagaacgccgtaacagaactacaactactcatgcaatcaacaccggccaccggctccggttccgccatatgctccggagtggccgtgtgcaaggtcctccaccttgaaggggaagttaacaaaatcaaatcagccctcctctccactaacaaagccgtagtatccctaagcaacggtgtatccgtcctcaccttcaaagtactagacctaaagaattatatcgacaaacaactcctccccatactcaacaaacaatcctgctccataagcaacatcgaaacagtcatcgagttccagcagaaaaacaaccgactcctcgaaataacccgcgagttctcagtcaacgccggagtcaccacacccgtcagcacctacatgctgaccaactccgaactcctctccttaatcaatgacatgcccatcaccaatgaccaaaagaaactcatgtcaaacaacgtccaaatagtacgccaacaatcctactccatcatgtgcatcataaaagaagaagtactcgcctacgtcgtccaactccccctctacggcgtaatcgacaccccctgctggaaactacacacaagccccctctgcaccacaaacactaaagagggctccaacatctgtctaacccgcaccgatcgaggctggtactgcgacaacgccggatctgtctcattcttcccccaagccgaaacctgcaaagtccaatccaaccgcgtcttctgcgacaccatgaactcgagaaccctcccttccgaagtcaacctatgcaacgtcgacattttcaaccccaaatacgactgcaaaatcatgacctcgaaaaccgacgtatcatccagcgtcatcaccagcctaggcgcaatcgtgagctgctacggcaaaaccaaatgcaccgcgagcaataaaaaccgcgggatcatcaaaactttctccaacggctgcgactacgtctccaacaagggagtcgataccgtctccgtaggcaacaccctctactgcgtcaacaaacaagaaggcaaatcactatacgtaaaaggcgagccaatcataaacttctacgaccctctagttttcccatccgacgagttcgacgctagcatctcccaagtcaacgagaaaatcaaccaatccctcgcattcatccgcaaatccgacgaactcctccacaacgtaaacgcaggcaaatcaactactaatataatgatcacaaccatcataatagtcataatcgtaatcctcctatccctcatcgccgtcggactactgctctactgcaaagcccgctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5262 - RNA, 2139 nt, synthetic construct
  misc_feature 1..2139: note = mRNA product Design h-2 comprising derived and/or modified sequence from HRSV(A2)__F-del_DSCav1_mut4 (opt1)
  source 1..2139: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5263 - RNA, 2139 nt, synthetic construct
  misc_feature 1..2139: note = mRNA product Design h-2 comprising derived and/or modified sequence from HRSV(A2)__F-del_DSCav1_mut4 (opt1)
  source 1..2139: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatctgcagcggcgtggccgtgtgcaaggtcctgcacctcgagggcgaggtgaacaagatcaagtccgcgctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgccggctccgtgagcttcttcccccaggcggagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactgcgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgccttcatccgcaagagcgacgagctgctgcacaacgtgaacgcggggaagtccaccaccaacatcatgatcaccacgatcatcatcgtgatcatcgtcatcctcctgagcctgatcgccgtgggcctcctgctgtactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5264 - RNA, 2139 nt, synthetic construct
  misc_feature 1..2139: note = mRNA product Design h-2 comprising derived and/or modified sequence from HRSV(A2)__F-del_DSCav1_mut4 (opt2)
  source 1..2139: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5265 - RNA, 2139 nt, synthetic construct
  misc_feature 1..2139: note = mRNA product Design h-2 comprising derived and/or modified sequence from HRSV(A2)__F-del_DSCav1_mut4 (opt3)
  source 1..2139: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatatgtagcggagtggcagtctgcaaggtgttgcacctcgagggcgaagttaacaaaatcaagagtgccctgctgtccacgaataaagctgtggtctctctcagcaacggtgtgtccgtattaacttttaaggttctggaccttaagaattacattgataaacaattgctgcctatcctaaacaagcagtcatgtagtattagcaatatcgagaccgtgatagagttccagcagaaaaacaataggctcctggaaattacacgggagttttctgtcaacgccggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgcattataaaggaggaagtgttagcgtatgtagtgcaactgcccctctacggagtcatcgacactccttgttggaaacttcatacaagcccactgtgcaccactaatacaaaggagggctcgaacatttgtttgacccgaacggatcgtggctggtactgcgacaatgcagggtctgtgtccttctttccccaggccgaaacctgtaaggttcagtcaaacagagtgttctgcgatacaatgaatagtagaactctgcctagcgaggtcaacctctgcaatgtggacatctttaacccaaaatatgattgtaagataatgacctccaaaacagacgtatctagctcagttattaccagtctgggagctatcgtgtcctgctacggtaagactaaatgtacagccagcaataagaacaggggcatcattaagaccttctctaatgggtgcgattatgtctcaaacaaaggagtggacactgtcagtgtgggcaatacgctttactgtgttaacaagcaagagggtaaaagcctgtatgtgaagggggaacccatcattaacttttacgaccctttggtattcccatccgatgagtttgacgcatctatatcgcaggtcaatgagaaaatcaaccagagcctcgctttcattcggaagtccgatgaactgttacacaatgtgaacgccggaaagtcaacaaccaatatcatgatcactaccattataatcgttattatcgtgattctgctaagtctcatcgcggtcggcctgcttttgtattgcaaagcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5266 - RNA, 2139 nt, synthetic construct
  misc_feature 1..2139: note = mRNA product Design h-2 comprising derived and/or modified sequence from HRSV(A2)__F-del_DSCav1_mut4 (opt4)
  source 1..2139: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5267 - RNA, 2139 nt, synthetic construct
  misc_feature 1..2139: note = mRNA product Design h-2 comprising derived and/or modified sequence from HRSV(A2)__F-del_DSCav1_mut4 (opt5)
  source 1..2139: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctatttgttccggcgtcgccgtgtgcaaggttctccacctggagggggaagtgaacaaaatcaagagcgcgcttctgtctaccaataaagccgtcgtgtccctcagcaacggagtttctgtgctgacatttaaggtccttgacctgaagaattacattgataaacaactcctgcctatcctgaacaagcagtcctgtagcatttctaatatcgagaccgtgattgagttccagcagaaaaacaatcggctcctggaaatcacgcgcgagttttccgtgaacgctggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgcatcattaaggaggaagtcctggcctatgtggttcaactccctctgtacggcgtgatcgacacaccctgttggaaactgcatacgtctcctctctgcaccacaaataccaaggaggggtccaacatctgtctgacacggaccgatcgcggatggtactgcgacaatgctggcagcgtctctttctttccccaggccgaaacgtgtaaggtgcagagcaacagagttttctgcgatacaatgaactccagaaccctgccttctgaggtgaatctctgcaatgtcgacatttttaacccgaaatatgattgtaagatcatgaccagcaaaacagacgtgtccagctctgtcattacctccctgggggcgatcgtgagctgctacggaaagacaaaatgtacggcctctaataagaaccggggcattatcaagaccttctccaatgggtgcgattatgttagcaacaaaggagtggacacagtctccgtgggcaataccctttactgtgttaacaagcaagagggcaaatctctgtatgtgaagggggaacccatcattaacttttacgaccctctcgtcttccccagcgatgagtttgacgcttccatctctcaggtgaatgagaaaattaaccagagcctggccttcatccgcaagtccgatgaactgctccacaatgtgaacgctggaaagagcacaaccaatattatgatcacgaccattatcatcgttattatcgtcattctgctttctctgatcgccgtgggcctcctgctgtattgcaaagccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5268 - RNA, 2139 nt, synthetic construct
  misc_feature 1..2139: note = mRNA product Design h-2 comprising derived and/or modified sequence from HRSV(A2)__F-del_DSCav1_mut4 (opt6)
  source 1..2139: mol_type = other RNA
gggagacccgtgacccggaagttgtacggctacgcgactttccctcccacaaaccctcgcgcccttcctttcctacttgggcccggcagaaagcttaccatggaacttttaatactaaaagctaacgccataaccactatactaacagcagtcacattctgcttcgcatcaggccaaaacataaccgaagaattttaccaatccacttgttcagcagtctccaaaggatatttatccgcacttcgtacaggatggtatacatcagtaataacaatagaactctccaacataaaagaaaataaatgcaacggcaccgacgcaaaagtaaaactcatcaaacaagaattagacaaatacaagaacgccgtaacagaactacaattactaatgcaatcaacacccgccacaggatcaggatctgcaatatgctctggagtagcagtatgcaaagtattacacctagaaggagaagtaaacaaaatcaaaagcgcactactatccacaaacaaagctgtagtatcactatcaaacggagtatcagtattaactttcaaagtacttgatctaaaaaactacatagacaaacaactactacccatattaaacaaacaatcatgctcaataagcaatatagaaacagtaatagaatttcaacaaaaaaacaacagactactagaaatcacaagggaattttcagtaaatgccggtgttacaaccccagtatcaacatacatgctaactaactcagaactactatccttaataaacgatatgccaataacaaacgatcaaaaaaaactaatgtccaacaacgtacaaatagtaagacaacaatcatactcaatcatgtgcattataaaagaagaagtcttagcatacgtagtacaattaccactatacggtgtaatagatacaccatgttggaaattacacacaagcccactatgcacaactaacacaaaagaaggctcaaatatatgtttaacaagaacagaccgaggttggtactgcgacaatgcaggatcagtatcattctttccacaagcagaaacatgtaaagttcaatccaacagagtattctgcgacacaatgaactccagaacactaccttcagaagtaaacctctgtaacgtagacatatttaatcccaagtacgactgcaaaataatgacatcgaaaacagacgtaagctcctcagtgataacatccctcggcgccatcgtatcctgttacggtaaaactaaatgtaccgcctcaaacaaaaaccgcggtattataaaaactttttctaatggctgcgattacgtaagcaacaaaggcgtcgacacagtttccgtaggaaacacactatactgcgtaaacaaacaagaaggtaaatctctatacgtaaaaggagaaccaataataaatttctatgatcctttagtattcccatccgatgaatttgacgcctctatctcacaagtcaacgaaaaaataaatcaatcattagcattcatacgaaaatcagacgaactactacacaacgtaaacgcaggaaaatcaacaaccaacataatgataaccacaataataatagttattatagtgatactattatccttaattgcagtcggactattattatactgtaaagcacgctaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5269 - RNA, 2139 nt, synthetic construct
  misc_feature 1..2139: note = mRNA product Design h-2 comprising derived and/or modified sequence from HRSV(A2)__F-del_DSCav1_mut4 (opt11)
  source 1..2139: mol_type = other RNA
gggagacccgtgacccggaagttgtacggctacgcgactttccctcccacaaaccctcgcgcccttcctttcctacttgggcccggcagaaagcttaccatggaactcctcatcctcaaagccaatgccatcaccacaatcctgacagcagtaaccttctgcttcgcatccggacaaaacatcaccgaagaattttaccagtcaacctgctccgctgtctcaaaaggctacctctcagcccttcgcaccggctggtacacctcggtcataacaatagaactctccaatatcaaagaaaacaaatgcaacggcactgacgccaaggtaaaactcatcaaacaggaactcgataaatacaagaacgccgtaacagaactacaactactcatgcaatcaacaccggccaccggctccggttccgccatatgctccggagtggccgtgtgcaaggtcctccaccttgaaggggaagttaacaaaatcaaatcagccctcctctccactaacaaagccgtagtatccctaagcaacggtgtatccgtcctcaccttcaaagtactagacctaaagaattatatcgacaaacaactcctccccatactcaacaaacaatcctgctccataagcaacatcgaaacagtcatcgagttccagcagaaaaacaaccgactcctcgaaataacccgcgagttctcagtcaacgccggagtcaccacacccgtcagcacctacatgctgaccaactccgaactcctctccttaatcaatgacatgcccatcaccaatgaccaaaagaaactcatgtcaaacaacgtccaaatagtacgccaacaatcctactccatcatgtgcatcataaaagaagaagtactcgcctacgtcgtccaactccccctctacggcgtaatcgacaccccctgctggaaactacacacaagccccctctgcaccacaaacactaaagagggctccaacatctgtctaacccgcaccgatcgaggctggtactgcgacaacgccggatctgtctcattcttcccccaagccgaaacctgcaaagtccaatccaaccgcgtcttctgcgacaccatgaactcgagaaccctcccttccgaagtcaacctatgcaacgtcgacattttcaaccccaaatacgactgcaaaatcatgacctcgaaaaccgacgtatcatccagcgtcatcaccagcctaggcgcaatcgtgagctgctacggcaaaaccaaatgcaccgcgagcaataaaaaccgcgggatcatcaaaactttctccaacggctgcgactacgtctccaacaagggagtcgataccgtctccgtaggcaacaccctctactgcgtcaacaaacaagaaggcaaatcactatacgtaaaaggcgagccaatcataaacttctacgaccctctagttttcccatccgacgagttcgacgctagcatctcccaagtcaacgagaaaatcaaccaatccctcgcattcatccgcaaatccgacgaactcctccacaacgtaaacgcaggcaaatcaactactaatataatgatcacaaccatcataatagtcataatcgtaatcctcctatccctcatcgccgtcggactactgctctactgcaaagcccgctaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5270 - RNA, 1919 nt, synthetic construct
  misc_feature 1..1919: note = mRNA product Design h-3 comprising derived and/or modified sequence from HRSV(A2)__F-del_DSCav1_mut4 (opt1)
  source 1..1919: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5271 - RNA, 1919 nt, synthetic construct
  misc_feature 1..1919: note = mRNA product Design h-3 comprising derived and/or modified sequence from HRSV(A2)__F-del_DSCav1_mut4 (opt1)
  source 1..1919: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatctgcagcggcgtggccgtgtgcaaggtcctgcacctcgagggcgaggtgaacaagatcaagtccgcgctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgccggctccgtgagcttcttcccccaggcggagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactgcgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgccttcatccgcaagagcgacgagctgctgcacaacgtgaacgcggggaagtccaccaccaacatcatgatcaccacgatcatcatcgtgatcatcgtcatcctcctgagcctgatcgccgtgggcctcctgctgtactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5272 - RNA, 1919 nt, synthetic construct
  misc_feature 1..1919: note = mRNA product Design h-3 comprising derived and/or modified sequence from HRSV(A2)__F-del_DSCav1_mut4 (opt2)
  source 1..1919: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5273 - RNA, 1919 nt, synthetic construct
  misc_feature 1..1919: note = mRNA product Design h-3 comprising derived and/or modified sequence from HRSV(A2)__F-del_DSCav1_mut4 (opt3)
  source 1..1919: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatatgtagcggagtggcagtctgcaaggtgttgcacctcgagggcgaagttaacaaaatcaagagtgccctgctgtccacgaataaagctgtggtctctctcagcaacggtgtgtccgtattaacttttaaggttctggaccttaagaattacattgataaacaattgctgcctatcctaaacaagcagtcatgtagtattagcaatatcgagaccgtgatagagttccagcagaaaaacaataggctcctggaaattacacgggagttttctgtcaacgccggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgcattataaaggaggaagtgttagcgtatgtagtgcaactgcccctctacggagtcatcgacactccttgttggaaacttcatacaagcccactgtgcaccactaatacaaaggagggctcgaacatttgtttgacccgaacggatcgtggctggtactgcgacaatgcagggtctgtgtccttctttccccaggccgaaacctgtaaggttcagtcaaacagagtgttctgcgatacaatgaatagtagaactctgcctagcgaggtcaacctctgcaatgtggacatctttaacccaaaatatgattgtaagataatgacctccaaaacagacgtatctagctcagttattaccagtctgggagctatcgtgtcctgctacggtaagactaaatgtacagccagcaataagaacaggggcatcattaagaccttctctaatgggtgcgattatgtctcaaacaaaggagtggacactgtcagtgtgggcaatacgctttactgtgttaacaagcaagagggtaaaagcctgtatgtgaagggggaacccatcattaacttttacgaccctttggtattcccatccgatgagtttgacgcatctatatcgcaggtcaatgagaaaatcaaccagagcctcgctttcattcggaagtccgatgaactgttacacaatgtgaacgccggaaagtcaacaaccaatatcatgatcactaccattataatcgttattatcgtgattctgctaagtctcatcgcggtcggcctgcttttgtattgcaaagcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5274 - RNA, 1919 nt, synthetic construct
  misc_feature 1..1919: note = mRNA product Design h-3 comprising derived and/or modified sequence from HRSV(A2)__F-del_DSCav1_mut4 (opt4)
  source 1..1919: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5275 - RNA, 1919 nt, synthetic construct
  misc_feature 1..1919: note = mRNA product Design h-3 comprising derived and/or modified sequence from HRSV(A2)__F-del_DSCav1_mut4 (opt5)
  source 1..1919: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctatttgttccggcgtcgccgtgtgcaaggttctccacctggagggggaagtgaacaaaatcaagagcgcgcttctgtctaccaataaagccgtcgtgtccctcagcaacggagtttctgtgctgacatttaaggtccttgacctgaagaattacattgataaacaactcctgcctatcctgaacaagcagtcctgtagcatttctaatatcgagaccgtgattgagttccagcagaaaaacaatcggctcctggaaatcacgcgcgagttttccgtgaacgctggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgcatcattaaggaggaagtcctggcctatgtggttcaactccctctgtacggcgtgatcgacacaccctgttggaaactgcatacgtctcctctctgcaccacaaataccaaggaggggtccaacatctgtctgacacggaccgatcgcggatggtactgcgacaatgctggcagcgtctctttctttccccaggccgaaacgtgtaaggtgcagagcaacagagttttctgcgatacaatgaactccagaaccctgccttctgaggtgaatctctgcaatgtcgacatttttaacccgaaatatgattgtaagatcatgaccagcaaaacagacgtgtccagctctgtcattacctccctgggggcgatcgtgagctgctacggaaagacaaaatgtacggcctctaataagaaccggggcattatcaagaccttctccaatgggtgcgattatgttagcaacaaaggagtggacacagtctccgtgggcaataccctttactgtgttaacaagcaagagggcaaatctctgtatgtgaagggggaacccatcattaacttttacgaccctctcgtcttccccagcgatgagtttgacgcttccatctctcaggtgaatgagaaaattaaccagagcctggccttcatccgcaagtccgatgaactgctccacaatgtgaacgctggaaagagcacaaccaatattatgatcacgaccattatcatcgttattatcgtcattctgctttctctgatcgccgtgggcctcctgctgtattgcaaagccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5276 - RNA, 1919 nt, synthetic construct
  misc_feature 1..1919: note = mRNA product Design h-3 comprising derived and/or modified sequence from HRSV(A2)__F-del_DSCav1_mut4 (opt6)
  source 1..1919: mol_type = other RNA
gggagacccgtgacccggaagttgtacggctacgcgactttccctcccacaaaccctcgcgcccttcctttcctacttgggcccggcagaaagcttaccatggaacttttaatactaaaagctaacgccataaccactatactaacagcagtcacattctgcttcgcatcaggccaaaacataaccgaagaattttaccaatccacttgttcagcagtctccaaaggatatttatccgcacttcgtacaggatggtatacatcagtaataacaatagaactctccaacataaaagaaaataaatgcaacggcaccgacgcaaaagtaaaactcatcaaacaagaattagacaaatacaagaacgccgtaacagaactacaattactaatgcaatcaacacccgccacaggatcaggatctgcaatatgctctggagtagcagtatgcaaagtattacacctagaaggagaagtaaacaaaatcaaaagcgcactactatccacaaacaaagctgtagtatcactatcaaacggagtatcagtattaactttcaaagtacttgatctaaaaaactacatagacaaacaactactacccatattaaacaaacaatcatgctcaataagcaatatagaaacagtaatagaatttcaacaaaaaaacaacagactactagaaatcacaagggaattttcagtaaatgccggtgttacaaccccagtatcaacatacatgctaactaactcagaactactatccttaataaacgatatgccaataacaaacgatcaaaaaaaactaatgtccaacaacgtacaaatagtaagacaacaatcatactcaatcatgtgcattataaaagaagaagtcttagcatacgtagtacaattaccactatacggtgtaatagatacaccatgttggaaattacacacaagcccactatgcacaactaacacaaaagaaggctcaaatatatgtttaacaagaacagaccgaggttggtactgcgacaatgcaggatcagtatcattctttccacaagcagaaacatgtaaagttcaatccaacagagtattctgcgacacaatgaactccagaacactaccttcagaagtaaacctctgtaacgtagacatatttaatcccaagtacgactgcaaaataatgacatcgaaaacagacgtaagctcctcagtgataacatccctcggcgccatcgtatcctgttacggtaaaactaaatgtaccgcctcaaacaaaaaccgcggtattataaaaactttttctaatggctgcgattacgtaagcaacaaaggcgtcgacacagtttccgtaggaaacacactatactgcgtaaacaaacaagaaggtaaatctctatacgtaaaaggagaaccaataataaatttctatgatcctttagtattcccatccgatgaatttgacgcctctatctcacaagtcaacgaaaaaataaatcaatcattagcattcatacgaaaatcagacgaactactacacaacgtaaacgcaggaaaatcaacaaccaacataatgataaccacaataataatagttattatagtgatactattatccttaattgcagtcggactattattatactgtaaagcacgctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5277 - RNA, 1919 nt, synthetic construct
  misc_feature 1..1919: note = mRNA product Design h-3 comprising derived and/or modified sequence from HRSV(A2)__F-del_DSCav1_mut4 (opt11)
  source 1..1919: mol_type = other RNA
gggagacccgtgacccggaagttgtacggctacgcgactttccctcccacaaaccctcgcgcccttcctttcctacttgggcccggcagaaagcttaccatggaactcctcatcctcaaagccaatgccatcaccacaatcctgacagcagtaaccttctgcttcgcatccggacaaaacatcaccgaagaattttaccagtcaacctgctccgctgtctcaaaaggctacctctcagcccttcgcaccggctggtacacctcggtcataacaatagaactctccaatatcaaagaaaacaaatgcaacggcactgacgccaaggtaaaactcatcaaacaggaactcgataaatacaagaacgccgtaacagaactacaactactcatgcaatcaacaccggccaccggctccggttccgccatatgctccggagtggccgtgtgcaaggtcctccaccttgaaggggaagttaacaaaatcaaatcagccctcctctccactaacaaagccgtagtatccctaagcaacggtgtatccgtcctcaccttcaaagtactagacctaaagaattatatcgacaaacaactcctccccatactcaacaaacaatcctgctccataagcaacatcgaaacagtcatcgagttccagcagaaaaacaaccgactcctcgaaataacccgcgagttctcagtcaacgccggagtcaccacacccgtcagcacctacatgctgaccaactccgaactcctctccttaatcaatgacatgcccatcaccaatgaccaaaagaaactcatgtcaaacaacgtccaaatagtacgccaacaatcctactccatcatgtgcatcataaaagaagaagtactcgcctacgtcgtccaactccccctctacggcgtaatcgacaccccctgctggaaactacacacaagccccctctgcaccacaaacactaaagagggctccaacatctgtctaacccgcaccgatcgaggctggtactgcgacaacgccggatctgtctcattcttcccccaagccgaaacctgcaaagtccaatccaaccgcgtcttctgcgacaccatgaactcgagaaccctcccttccgaagtcaacctatgcaacgtcgacattttcaaccccaaatacgactgcaaaatcatgacctcgaaaaccgacgtatcatccagcgtcatcaccagcctaggcgcaatcgtgagctgctacggcaaaaccaaatgcaccgcgagcaataaaaaccgcgggatcatcaaaactttctccaacggctgcgactacgtctccaacaagggagtcgataccgtctccgtaggcaacaccctctactgcgtcaacaaacaagaaggcaaatcactatacgtaaaaggcgagccaatcataaacttctacgaccctctagttttcccatccgacgagttcgacgctagcatctcccaagtcaacgagaaaatcaaccaatccctcgcattcatccgcaaatccgacgaactcctccacaacgtaaacgcaggcaaatcaactactaatataatgatcacaaccatcataatagtcataatcgtaatcctcctatccctcatcgccgtcggactactgctctactgcaaagcccgctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5278 - RNA, 1982 nt, synthetic construct
  misc_feature 1..1982: note = mRNA product Design h-4 comprising derived and/or modified sequence from HRSV(A2)__F-del_DSCav1_mut4 (opt1)
  source 1..1982: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5279 - RNA, 1982 nt, synthetic construct
  misc_feature 1..1982: note = mRNA product Design h-4 comprising derived and/or modified sequence from HRSV(A2)__F-del_DSCav1_mut4 (opt1)
  source 1..1982: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatctgcagcggcgtggccgtgtgcaaggtcctgcacctcgagggcgaggtgaacaagatcaagtccgcgctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgccggctccgtgagcttcttcccccaggcggagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactgcgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgccttcatccgcaagagcgacgagctgctgcacaacgtgaacgcggggaagtccaccaccaacatcatgatcaccacgatcatcatcgtgatcatcgtcatcctcctgagcctgatcgccgtgggcctcctgctgtactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5280 - RNA, 1982 nt, synthetic construct
  misc_feature 1..1982: note = mRNA product Design h-4 comprising derived and/or modified sequence from HRSV(A2)__F-del_DSCav1_mut4 (opt2)
  source 1..1982: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5281 - RNA, 1982 nt, synthetic construct
  misc_feature 1..1982: note = mRNA product Design h-4 comprising derived and/or modified sequence from HRSV(A2)__F-del_DSCav1_mut4 (opt3)
  source 1..1982: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatatgtagcggagtggcagtctgcaaggtgttgcacctcgagggcgaagttaacaaaatcaagagtgccctgctgtccacgaataaagctgtggtctctctcagcaacggtgtgtccgtattaacttttaaggttctggaccttaagaattacattgataaacaattgctgcctatcctaaacaagcagtcatgtagtattagcaatatcgagaccgtgatagagttccagcagaaaaacaataggctcctggaaattacacgggagttttctgtcaacgccggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgcattataaaggaggaagtgttagcgtatgtagtgcaactgcccctctacggagtcatcgacactccttgttggaaacttcatacaagcccactgtgcaccactaatacaaaggagggctcgaacatttgtttgacccgaacggatcgtggctggtactgcgacaatgcagggtctgtgtccttctttccccaggccgaaacctgtaaggttcagtcaaacagagtgttctgcgatacaatgaatagtagaactctgcctagcgaggtcaacctctgcaatgtggacatctttaacccaaaatatgattgtaagataatgacctccaaaacagacgtatctagctcagttattaccagtctgggagctatcgtgtcctgctacggtaagactaaatgtacagccagcaataagaacaggggcatcattaagaccttctctaatgggtgcgattatgtctcaaacaaaggagtggacactgtcagtgtgggcaatacgctttactgtgttaacaagcaagagggtaaaagcctgtatgtgaagggggaacccatcattaacttttacgaccctttggtattcccatccgatgagtttgacgcatctatatcgcaggtcaatgagaaaatcaaccagagcctcgctttcattcggaagtccgatgaactgttacacaatgtgaacgccggaaagtcaacaaccaatatcatgatcactaccattataatcgttattatcgtgattctgctaagtctcatcgcggtcggcctgcttttgtattgcaaagcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5282 - RNA, 1982 nt, synthetic construct
  misc_feature 1..1982: note = mRNA product Design h-4 comprising derived and/or modified sequence from HRSV(A2)__F-del_DSCav1_mut4 (opt4)
  source 1..1982: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5283 - RNA, 1982 nt, synthetic construct
  misc_feature 1..1982: note = mRNA product Design h-4 comprising derived and/or modified sequence from HRSV(A2)__F-del_DSCav1_mut4 (opt5)
  source 1..1982: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctatttgttccggcgtcgccgtgtgcaaggttctccacctggagggggaagtgaacaaaatcaagagcgcgcttctgtctaccaataaagccgtcgtgtccctcagcaacggagtttctgtgctgacatttaaggtccttgacctgaagaattacattgataaacaactcctgcctatcctgaacaagcagtcctgtagcatttctaatatcgagaccgtgattgagttccagcagaaaaacaatcggctcctggaaatcacgcgcgagttttccgtgaacgctggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgcatcattaaggaggaagtcctggcctatgtggttcaactccctctgtacggcgtgatcgacacaccctgttggaaactgcatacgtctcctctctgcaccacaaataccaaggaggggtccaacatctgtctgacacggaccgatcgcggatggtactgcgacaatgctggcagcgtctctttctttccccaggccgaaacgtgtaaggtgcagagcaacagagttttctgcgatacaatgaactccagaaccctgccttctgaggtgaatctctgcaatgtcgacatttttaacccgaaatatgattgtaagatcatgaccagcaaaacagacgtgtccagctctgtcattacctccctgggggcgatcgtgagctgctacggaaagacaaaatgtacggcctctaataagaaccggggcattatcaagaccttctccaatgggtgcgattatgttagcaacaaaggagtggacacagtctccgtgggcaataccctttactgtgttaacaagcaagagggcaaatctctgtatgtgaagggggaacccatcattaacttttacgaccctctcgtcttccccagcgatgagtttgacgcttccatctctcaggtgaatgagaaaattaaccagagcctggccttcatccgcaagtccgatgaactgctccacaatgtgaacgctggaaagagcacaaccaatattatgatcacgaccattatcatcgttattatcgtcattctgctttctctgatcgccgtgggcctcctgctgtattgcaaagccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5284 - RNA, 1982 nt, synthetic construct
  misc_feature 1..1982: note = mRNA product Design h-4 comprising derived and/or modified sequence from HRSV(A2)__F-del_DSCav1_mut4 (opt6)
  source 1..1982: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaacttttaatactaaaagctaacgccataaccactatactaacagcagtcacattctgcttcgcatcaggccaaaacataaccgaagaattttaccaatccacttgttcagcagtctccaaaggatatttatccgcacttcgtacaggatggtatacatcagtaataacaatagaactctccaacataaaagaaaataaatgcaacggcaccgacgcaaaagtaaaactcatcaaacaagaattagacaaatacaagaacgccgtaacagaactacaattactaatgcaatcaacacccgccacaggatcaggatctgcaatatgctctggagtagcagtatgcaaagtattacacctagaaggagaagtaaacaaaatcaaaagcgcactactatccacaaacaaagctgtagtatcactatcaaacggagtatcagtattaactttcaaagtacttgatctaaaaaactacatagacaaacaactactacccatattaaacaaacaatcatgctcaataagcaatatagaaacagtaatagaatttcaacaaaaaaacaacagactactagaaatcacaagggaattttcagtaaatgccggtgttacaaccccagtatcaacatacatgctaactaactcagaactactatccttaataaacgatatgccaataacaaacgatcaaaaaaaactaatgtccaacaacgtacaaatagtaagacaacaatcatactcaatcatgtgcattataaaagaagaagtcttagcatacgtagtacaattaccactatacggtgtaatagatacaccatgttggaaattacacacaagcccactatgcacaactaacacaaaagaaggctcaaatatatgtttaacaagaacagaccgaggttggtactgcgacaatgcaggatcagtatcattctttccacaagcagaaacatgtaaagttcaatccaacagagtattctgcgacacaatgaactccagaacactaccttcagaagtaaacctctgtaacgtagacatatttaatcccaagtacgactgcaaaataatgacatcgaaaacagacgtaagctcctcagtgataacatccctcggcgccatcgtatcctgttacggtaaaactaaatgtaccgcctcaaacaaaaaccgcggtattataaaaactttttctaatggctgcgattacgtaagcaacaaaggcgtcgacacagtttccgtaggaaacacactatactgcgtaaacaaacaagaaggtaaatctctatacgtaaaaggagaaccaataataaatttctatgatcctttagtattcccatccgatgaatttgacgcctctatctcacaagtcaacgaaaaaataaatcaatcattagcattcatacgaaaatcagacgaactactacacaacgtaaacgcaggaaaatcaacaaccaacataatgataaccacaataataatagttattatagtgatactattatccttaattgcagtcggactattattatactgtaaagcacgctaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5285 - RNA, 1982 nt, synthetic construct
  misc_feature 1..1982: note = mRNA product Design h-4 comprising derived and/or modified sequence from HRSV(A2)__F-del_DSCav1_mut4 (opt11)
  source 1..1982: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcctcatcctcaaagccaatgccatcaccacaatcctgacagcagtaaccttctgcttcgcatccggacaaaacatcaccgaagaattttaccagtcaacctgctccgctgtctcaaaaggctacctctcagcccttcgcaccggctggtacacctcggtcataacaatagaactctccaatatcaaagaaaacaaatgcaacggcactgacgccaaggtaaaactcatcaaacaggaactcgataaatacaagaacgccgtaacagaactacaactactcatgcaatcaacaccggccaccggctccggttccgccatatgctccggagtggccgtgtgcaaggtcctccaccttgaaggggaagttaacaaaatcaaatcagccctcctctccactaacaaagccgtagtatccctaagcaacggtgtatccgtcctcaccttcaaagtactagacctaaagaattatatcgacaaacaactcctccccatactcaacaaacaatcctgctccataagcaacatcgaaacagtcatcgagttccagcagaaaaacaaccgactcctcgaaataacccgcgagttctcagtcaacgccggagtcaccacacccgtcagcacctacatgctgaccaactccgaactcctctccttaatcaatgacatgcccatcaccaatgaccaaaagaaactcatgtcaaacaacgtccaaatagtacgccaacaatcctactccatcatgtgcatcataaaagaagaagtactcgcctacgtcgtccaactccccctctacggcgtaatcgacaccccctgctggaaactacacacaagccccctctgcaccacaaacactaaagagggctccaacatctgtctaacccgcaccgatcgaggctggtactgcgacaacgccggatctgtctcattcttcccccaagccgaaacctgcaaagtccaatccaaccgcgtcttctgcgacaccatgaactcgagaaccctcccttccgaagtcaacctatgcaacgtcgacattttcaaccccaaatacgactgcaaaatcatgacctcgaaaaccgacgtatcatccagcgtcatcaccagcctaggcgcaatcgtgagctgctacggcaaaaccaaatgcaccgcgagcaataaaaaccgcgggatcatcaaaactttctccaacggctgcgactacgtctccaacaagggagtcgataccgtctccgtaggcaacaccctctactgcgtcaacaaacaagaaggcaaatcactatacgtaaaaggcgagccaatcataaacttctacgaccctctagttttcccatccgacgagttcgacgctagcatctcccaagtcaacgagaaaatcaaccaatccctcgcattcatccgcaaatccgacgaactcctccacaacgtaaacgcaggcaaatcaactactaatataatgatcacaaccatcataatagtcataatcgtaatcctcctatccctcatcgccgtcggactactgctctactgcaaagcccgctaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5286 - RNA, 1998 nt, synthetic construct
  misc_feature 1..1998: note = mRNA product Design h-5 comprising derived and/or modified sequence from HRSV(A2)__F-del_DSCav1_mut4 (opt1)
  source 1..1998: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5287 - RNA, 1998 nt, synthetic construct
  misc_feature 1..1998: note = mRNA product Design h-5 comprising derived and/or modified sequence from HRSV(A2)__F-del_DSCav1_mut4 (opt1)
  source 1..1998: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatctgcagcggcgtggccgtgtgcaaggtcctgcacctcgagggcgaggtgaacaagatcaagtccgcgctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgccggctccgtgagcttcttcccccaggcggagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactgcgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgccttcatccgcaagagcgacgagctgctgcacaacgtgaacgcggggaagtccaccaccaacatcatgatcaccacgatcatcatcgtgatcatcgtcatcctcctgagcctgatcgccgtgggcctcctgctgtactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5288 - RNA, 1998 nt, synthetic construct
  misc_feature 1..1998: note = mRNA product Design h-5 comprising derived and/or modified sequence from HRSV(A2)__F-del_DSCav1_mut4 (opt2)
  source 1..1998: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5289 - RNA, 1998 nt, synthetic construct
  misc_feature 1..1998: note = mRNA product Design h-5 comprising derived and/or modified sequence from HRSV(A2)__F-del_DSCav1_mut4 (opt3)
  source 1..1998: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatatgtagcggagtggcagtctgcaaggtgttgcacctcgagggcgaagttaacaaaatcaagagtgccctgctgtccacgaataaagctgtggtctctctcagcaacggtgtgtccgtattaacttttaaggttctggaccttaagaattacattgataaacaattgctgcctatcctaaacaagcagtcatgtagtattagcaatatcgagaccgtgatagagttccagcagaaaaacaataggctcctggaaattacacgggagttttctgtcaacgccggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgcattataaaggaggaagtgttagcgtatgtagtgcaactgcccctctacggagtcatcgacactccttgttggaaacttcatacaagcccactgtgcaccactaatacaaaggagggctcgaacatttgtttgacccgaacggatcgtggctggtactgcgacaatgcagggtctgtgtccttctttccccaggccgaaacctgtaaggttcagtcaaacagagtgttctgcgatacaatgaatagtagaactctgcctagcgaggtcaacctctgcaatgtggacatctttaacccaaaatatgattgtaagataatgacctccaaaacagacgtatctagctcagttattaccagtctgggagctatcgtgtcctgctacggtaagactaaatgtacagccagcaataagaacaggggcatcattaagaccttctctaatgggtgcgattatgtctcaaacaaaggagtggacactgtcagtgtgggcaatacgctttactgtgttaacaagcaagagggtaaaagcctgtatgtgaagggggaacccatcattaacttttacgaccctttggtattcccatccgatgagtttgacgcatctatatcgcaggtcaatgagaaaatcaaccagagcctcgctttcattcggaagtccgatgaactgttacacaatgtgaacgccggaaagtcaacaaccaatatcatgatcactaccattataatcgttattatcgtgattctgctaagtctcatcgcggtcggcctgcttttgtattgcaaagcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5290 - RNA, 1998 nt, synthetic construct
  misc_feature 1..1998: note = mRNA product Design h-5 comprising derived and/or modified sequence from HRSV(A2)__F-del_DSCav1_mut4 (opt4)
  source 1..1998: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5291 - RNA, 1998 nt, synthetic construct
  misc_feature 1..1998: note = mRNA product Design h-5 comprising derived and/or modified sequence from HRSV(A2)__F-del_DSCav1_mut4 (opt5)
  source 1..1998: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctatttgttccggcgtcgccgtgtgcaaggttctccacctggagggggaagtgaacaaaatcaagagcgcgcttctgtctaccaataaagccgtcgtgtccctcagcaacggagtttctgtgctgacatttaaggtccttgacctgaagaattacattgataaacaactcctgcctatcctgaacaagcagtcctgtagcatttctaatatcgagaccgtgattgagttccagcagaaaaacaatcggctcctggaaatcacgcgcgagttttccgtgaacgctggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgcatcattaaggaggaagtcctggcctatgtggttcaactccctctgtacggcgtgatcgacacaccctgttggaaactgcatacgtctcctctctgcaccacaaataccaaggaggggtccaacatctgtctgacacggaccgatcgcggatggtactgcgacaatgctggcagcgtctctttctttccccaggccgaaacgtgtaaggtgcagagcaacagagttttctgcgatacaatgaactccagaaccctgccttctgaggtgaatctctgcaatgtcgacatttttaacccgaaatatgattgtaagatcatgaccagcaaaacagacgtgtccagctctgtcattacctccctgggggcgatcgtgagctgctacggaaagacaaaatgtacggcctctaataagaaccggggcattatcaagaccttctccaatgggtgcgattatgttagcaacaaaggagtggacacagtctccgtgggcaataccctttactgtgttaacaagcaagagggcaaatctctgtatgtgaagggggaacccatcattaacttttacgaccctctcgtcttccccagcgatgagtttgacgcttccatctctcaggtgaatgagaaaattaaccagagcctggccttcatccgcaagtccgatgaactgctccacaatgtgaacgctggaaagagcacaaccaatattatgatcacgaccattatcatcgttattatcgtcattctgctttctctgatcgccgtgggcctcctgctgtattgcaaagccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5292 - RNA, 1998 nt, synthetic construct
  misc_feature 1..1998: note = mRNA product Design h-5 comprising derived and/or modified sequence from HRSV(A2)__F-del_DSCav1_mut4 (opt6)
  source 1..1998: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaacttttaatactaaaagctaacgccataaccactatactaacagcagtcacattctgcttcgcatcaggccaaaacataaccgaagaattttaccaatccacttgttcagcagtctccaaaggatatttatccgcacttcgtacaggatggtatacatcagtaataacaatagaactctccaacataaaagaaaataaatgcaacggcaccgacgcaaaagtaaaactcatcaaacaagaattagacaaatacaagaacgccgtaacagaactacaattactaatgcaatcaacacccgccacaggatcaggatctgcaatatgctctggagtagcagtatgcaaagtattacacctagaaggagaagtaaacaaaatcaaaagcgcactactatccacaaacaaagctgtagtatcactatcaaacggagtatcagtattaactttcaaagtacttgatctaaaaaactacatagacaaacaactactacccatattaaacaaacaatcatgctcaataagcaatatagaaacagtaatagaatttcaacaaaaaaacaacagactactagaaatcacaagggaattttcagtaaatgccggtgttacaaccccagtatcaacatacatgctaactaactcagaactactatccttaataaacgatatgccaataacaaacgatcaaaaaaaactaatgtccaacaacgtacaaatagtaagacaacaatcatactcaatcatgtgcattataaaagaagaagtcttagcatacgtagtacaattaccactatacggtgtaatagatacaccatgttggaaattacacacaagcccactatgcacaactaacacaaaagaaggctcaaatatatgtttaacaagaacagaccgaggttggtactgcgacaatgcaggatcagtatcattctttccacaagcagaaacatgtaaagttcaatccaacagagtattctgcgacacaatgaactccagaacactaccttcagaagtaaacctctgtaacgtagacatatttaatcccaagtacgactgcaaaataatgacatcgaaaacagacgtaagctcctcagtgataacatccctcggcgccatcgtatcctgttacggtaaaactaaatgtaccgcctcaaacaaaaaccgcggtattataaaaactttttctaatggctgcgattacgtaagcaacaaaggcgtcgacacagtttccgtaggaaacacactatactgcgtaaacaaacaagaaggtaaatctctatacgtaaaaggagaaccaataataaatttctatgatcctttagtattcccatccgatgaatttgacgcctctatctcacaagtcaacgaaaaaataaatcaatcattagcattcatacgaaaatcagacgaactactacacaacgtaaacgcaggaaaatcaacaaccaacataatgataaccacaataataatagttattatagtgatactattatccttaattgcagtcggactattattatactgtaaagcacgctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5293 - RNA, 1998 nt, synthetic construct
  misc_feature 1..1998: note = mRNA product Design h-5 comprising derived and/or modified sequence from HRSV(A2)__F-del_DSCav1_mut4 (opt11)
  source 1..1998: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcctcatcctcaaagccaatgccatcaccacaatcctgacagcagtaaccttctgcttcgcatccggacaaaacatcaccgaagaattttaccagtcaacctgctccgctgtctcaaaaggctacctctcagcccttcgcaccggctggtacacctcggtcataacaatagaactctccaatatcaaagaaaacaaatgcaacggcactgacgccaaggtaaaactcatcaaacaggaactcgataaatacaagaacgccgtaacagaactacaactactcatgcaatcaacaccggccaccggctccggttccgccatatgctccggagtggccgtgtgcaaggtcctccaccttgaaggggaagttaacaaaatcaaatcagccctcctctccactaacaaagccgtagtatccctaagcaacggtgtatccgtcctcaccttcaaagtactagacctaaagaattatatcgacaaacaactcctccccatactcaacaaacaatcctgctccataagcaacatcgaaacagtcatcgagttccagcagaaaaacaaccgactcctcgaaataacccgcgagttctcagtcaacgccggagtcaccacacccgtcagcacctacatgctgaccaactccgaactcctctccttaatcaatgacatgcccatcaccaatgaccaaaagaaactcatgtcaaacaacgtccaaatagtacgccaacaatcctactccatcatgtgcatcataaaagaagaagtactcgcctacgtcgtccaactccccctctacggcgtaatcgacaccccctgctggaaactacacacaagccccctctgcaccacaaacactaaagagggctccaacatctgtctaacccgcaccgatcgaggctggtactgcgacaacgccggatctgtctcattcttcccccaagccgaaacctgcaaagtccaatccaaccgcgtcttctgcgacaccatgaactcgagaaccctcccttccgaagtcaacctatgcaacgtcgacattttcaaccccaaatacgactgcaaaatcatgacctcgaaaaccgacgtatcatccagcgtcatcaccagcctaggcgcaatcgtgagctgctacggcaaaaccaaatgcaccgcgagcaataaaaaccgcgggatcatcaaaactttctccaacggctgcgactacgtctccaacaagggagtcgataccgtctccgtaggcaacaccctctactgcgtcaacaaacaagaaggcaaatcactatacgtaaaaggcgagccaatcataaacttctacgaccctctagttttcccatccgacgagttcgacgctagcatctcccaagtcaacgagaaaatcaaccaatccctcgcattcatccgcaaatccgacgaactcctccacaacgtaaacgcaggcaaatcaactactaatataatgatcacaaccatcataatagtcataatcgtaatcctcctatccctcatcgccgtcggactactgctctactgcaaagcccgctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5294 - RNA, 1931 nt, synthetic construct
  misc_feature 1..1931: note = mRNA product Design i-1 comprising derived and/or modified sequence from HRSV(A2)__F-del_DSCav1_mut4 (opt1)
  source 1..1931: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5295 - RNA, 1931 nt, synthetic construct
  misc_feature 1..1931: note = mRNA product Design i-1 comprising derived and/or modified sequence from HRSV(A2)__F-del_DSCav1_mut4 (opt1)
  source 1..1931: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatctgcagcggcgtggccgtgtgcaaggtcctgcacctcgagggcgaggtgaacaagatcaagtccgcgctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgccggctccgtgagcttcttcccccaggcggagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactgcgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgccttcatccgcaagagcgacgagctgctgcacaacgtgaacgcggggaagtccaccaccaacatcatgatcaccacgatcatcatcgtgatcatcgtcatcctcctgagcctgatcgccgtgggcctcctgctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5296 - RNA, 1931 nt, synthetic construct
  misc_feature 1..1931: note = mRNA product Design i-1 comprising derived and/or modified sequence from HRSV(A2)__F-del_DSCav1_mut4 (opt2)
  source 1..1931: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5297 - RNA, 1931 nt, synthetic construct
  misc_feature 1..1931: note = mRNA product Design i-1 comprising derived and/or modified sequence from HRSV(A2)__F-del_DSCav1_mut4 (opt3)
  source 1..1931: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatatgtagcggagtggcagtctgcaaggtgttgcacctcgagggcgaagttaacaaaatcaagagtgccctgctgtccacgaataaagctgtggtctctctcagcaacggtgtgtccgtattaacttttaaggttctggaccttaagaattacattgataaacaattgctgcctatcctaaacaagcagtcatgtagtattagcaatatcgagaccgtgatagagttccagcagaaaaacaataggctcctggaaattacacgggagttttctgtcaacgccggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgcattataaaggaggaagtgttagcgtatgtagtgcaactgcccctctacggagtcatcgacactccttgttggaaacttcatacaagcccactgtgcaccactaatacaaaggagggctcgaacatttgtttgacccgaacggatcgtggctggtactgcgacaatgcagggtctgtgtccttctttccccaggccgaaacctgtaaggttcagtcaaacagagtgttctgcgatacaatgaatagtagaactctgcctagcgaggtcaacctctgcaatgtggacatctttaacccaaaatatgattgtaagataatgacctccaaaacagacgtatctagctcagttattaccagtctgggagctatcgtgtcctgctacggtaagactaaatgtacagccagcaataagaacaggggcatcattaagaccttctctaatgggtgcgattatgtctcaaacaaaggagtggacactgtcagtgtgggcaatacgctttactgtgttaacaagcaagagggtaaaagcctgtatgtgaagggggaacccatcattaacttttacgaccctttggtattcccatccgatgagtttgacgcatctatatcgcaggtcaatgagaaaatcaaccagagcctcgctttcattcggaagtccgatgaactgttacacaatgtgaacgccggaaagtcaacaaccaatatcatgatcactaccattataatcgttattatcgtgattctgctaagtctcatcgcggtcggcctgcttttgtattgcaaagcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5298 - RNA, 1931 nt, synthetic construct
  misc_feature 1..1931: note = mRNA product Design i-1 comprising derived and/or modified sequence from HRSV(A2)__F-del_DSCav1_mut4 (opt4)
  source 1..1931: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5299 - RNA, 1931 nt, synthetic construct
  misc_feature 1..1931: note = mRNA product Design i-1 comprising derived and/or modified sequence from HRSV(A2)__F-del_DSCav1_mut4 (opt5)
  source 1..1931: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctatttgttccggcgtcgccgtgtgcaaggttctccacctggagggggaagtgaacaaaatcaagagcgcgcttctgtctaccaataaagccgtcgtgtccctcagcaacggagtttctgtgctgacatttaaggtccttgacctgaagaattacattgataaacaactcctgcctatcctgaacaagcagtcctgtagcatttctaatatcgagaccgtgattgagttccagcagaaaaacaatcggctcctggaaatcacgcgcgagttttccgtgaacgctggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgcatcattaaggaggaagtcctggcctatgtggttcaactccctctgtacggcgtgatcgacacaccctgttggaaactgcatacgtctcctctctgcaccacaaataccaaggaggggtccaacatctgtctgacacggaccgatcgcggatggtactgcgacaatgctggcagcgtctctttctttccccaggccgaaacgtgtaaggtgcagagcaacagagttttctgcgatacaatgaactccagaaccctgccttctgaggtgaatctctgcaatgtcgacatttttaacccgaaatatgattgtaagatcatgaccagcaaaacagacgtgtccagctctgtcattacctccctgggggcgatcgtgagctgctacggaaagacaaaatgtacggcctctaataagaaccggggcattatcaagaccttctccaatgggtgcgattatgttagcaacaaaggagtggacacagtctccgtgggcaataccctttactgtgttaacaagcaagagggcaaatctctgtatgtgaagggggaacccatcattaacttttacgaccctctcgtcttccccagcgatgagtttgacgcttccatctctcaggtgaatgagaaaattaaccagagcctggccttcatccgcaagtccgatgaactgctccacaatgtgaacgctggaaagagcacaaccaatattatgatcacgaccattatcatcgttattatcgtcattctgctttctctgatcgccgtgggcctcctgctgtattgcaaagccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5300 - RNA, 1931 nt, synthetic construct
  misc_feature 1..1931: note = mRNA product Design i-1 comprising derived and/or modified sequence from HRSV(A2)__F-del_DSCav1_mut4 (opt6)
  source 1..1931: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaacttttaatactaaaagctaacgccataaccactatactaacagcagtcacattctgcttcgcatcaggccaaaacataaccgaagaattttaccaatccacttgttcagcagtctccaaaggatatttatccgcacttcgtacaggatggtatacatcagtaataacaatagaactctccaacataaaagaaaataaatgcaacggcaccgacgcaaaagtaaaactcatcaaacaagaattagacaaatacaagaacgccgtaacagaactacaattactaatgcaatcaacacccgccacaggatcaggatctgcaatatgctctggagtagcagtatgcaaagtattacacctagaaggagaagtaaacaaaatcaaaagcgcactactatccacaaacaaagctgtagtatcactatcaaacggagtatcagtattaactttcaaagtacttgatctaaaaaactacatagacaaacaactactacccatattaaacaaacaatcatgctcaataagcaatatagaaacagtaatagaatttcaacaaaaaaacaacagactactagaaatcacaagggaattttcagtaaatgccggtgttacaaccccagtatcaacatacatgctaactaactcagaactactatccttaataaacgatatgccaataacaaacgatcaaaaaaaactaatgtccaacaacgtacaaatagtaagacaacaatcatactcaatcatgtgcattataaaagaagaagtcttagcatacgtagtacaattaccactatacggtgtaatagatacaccatgttggaaattacacacaagcccactatgcacaactaacacaaaagaaggctcaaatatatgtttaacaagaacagaccgaggttggtactgcgacaatgcaggatcagtatcattctttccacaagcagaaacatgtaaagttcaatccaacagagtattctgcgacacaatgaactccagaacactaccttcagaagtaaacctctgtaacgtagacatatttaatcccaagtacgactgcaaaataatgacatcgaaaacagacgtaagctcctcagtgataacatccctcggcgccatcgtatcctgttacggtaaaactaaatgtaccgcctcaaacaaaaaccgcggtattataaaaactttttctaatggctgcgattacgtaagcaacaaaggcgtcgacacagtttccgtaggaaacacactatactgcgtaaacaaacaagaaggtaaatctctatacgtaaaaggagaaccaataataaatttctatgatcctttagtattcccatccgatgaatttgacgcctctatctcacaagtcaacgaaaaaataaatcaatcattagcattcatacgaaaatcagacgaactactacacaacgtaaacgcaggaaaatcaacaaccaacataatgataaccacaataataatagttattatagtgatactattatccttaattgcagtcggactattattatactgtaaagcacgctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5301 - RNA, 1931 nt, synthetic construct
  misc_feature 1..1931: note = mRNA product Design i-1 comprising derived and/or modified sequence from HRSV(A2)__F-del_DSCav1_mut4 (opt11)
  source 1..1931: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcctcatcctcaaagccaatgccatcaccacaatcctgacagcagtaaccttctgcttcgcatccggacaaaacatcaccgaagaattttaccagtcaacctgctccgctgtctcaaaaggctacctctcagcccttcgcaccggctggtacacctcggtcataacaatagaactctccaatatcaaagaaaacaaatgcaacggcactgacgccaaggtaaaactcatcaaacaggaactcgataaatacaagaacgccgtaacagaactacaactactcatgcaatcaacaccggccaccggctccggttccgccatatgctccggagtggccgtgtgcaaggtcctccaccttgaaggggaagttaacaaaatcaaatcagccctcctctccactaacaaagccgtagtatccctaagcaacggtgtatccgtcctcaccttcaaagtactagacctaaagaattatatcgacaaacaactcctccccatactcaacaaacaatcctgctccataagcaacatcgaaacagtcatcgagttccagcagaaaaacaaccgactcctcgaaataacccgcgagttctcagtcaacgccggagtcaccacacccgtcagcacctacatgctgaccaactccgaactcctctccttaatcaatgacatgcccatcaccaatgaccaaaagaaactcatgtcaaacaacgtccaaatagtacgccaacaatcctactccatcatgtgcatcataaaagaagaagtactcgcctacgtcgtccaactccccctctacggcgtaatcgacaccccctgctggaaactacacacaagccccctctgcaccacaaacactaaagagggctccaacatctgtctaacccgcaccgatcgaggctggtactgcgacaacgccggatctgtctcattcttcccccaagccgaaacctgcaaagtccaatccaaccgcgtcttctgcgacaccatgaactcgagaaccctcccttccgaagtcaacctatgcaacgtcgacattttcaaccccaaatacgactgcaaaatcatgacctcgaaaaccgacgtatcatccagcgtcatcaccagcctaggcgcaatcgtgagctgctacggcaaaaccaaatgcaccgcgagcaataaaaaccgcgggatcatcaaaactttctccaacggctgcgactacgtctccaacaagggagtcgataccgtctccgtaggcaacaccctctactgcgtcaacaaacaagaaggcaaatcactatacgtaaaaggcgagccaatcataaacttctacgaccctctagttttcccatccgacgagttcgacgctagcatctcccaagtcaacgagaaaatcaaccaatccctcgcattcatccgcaaatccgacgaactcctccacaacgtaaacgcaggcaaatcaactactaatataatgatcacaaccatcataatagtcataatcgtaatcctcctatccctcatcgccgtcggactactgctctactgcaaagcccgctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5302 - RNA, 1931 nt, synthetic construct
  misc_feature 1..1931: note = mRNA product Design i-2 comprising derived and/or modified sequence from HRSV(A2)__F-del_DSCav1_mut4 (opt1)
  source 1..1931: mol_type = other RNA
gggagaggcgctgcctacggaggtggcagccatctccttctcggcatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5303 - RNA, 1931 nt, synthetic construct
  misc_feature 1..1931: note = mRNA product Design i-2 comprising derived and/or modified sequence from HRSV(A2)__F-del_DSCav1_mut4 (opt1)
  source 1..1931: mol_type = other RNA
gggagaggcgctgcctacggaggtggcagccatctccttctcggcatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatctgcagcggcgtggccgtgtgcaaggtcctgcacctcgagggcgaggtgaacaagatcaagtccgcgctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgccggctccgtgagcttcttcccccaggcggagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactgcgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgccttcatccgcaagagcgacgagctgctgcacaacgtgaacgcggggaagtccaccaccaacatcatgatcaccacgatcatcatcgtgatcatcgtcatcctcctgagcctgatcgccgtgggcctcctgctgtactgcaaggcccggtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5304 - RNA, 1931 nt, synthetic construct
  misc_feature 1..1931: note = mRNA product Design i-2 comprising derived and/or modified sequence from HRSV(A2)__F-del_DSCav1_mut4 (opt2)
  source 1..1931: mol_type = other RNA
gggagaggcgctgcctacggaggtggcagccatctccttctcggcatcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5305 - RNA, 1931 nt, synthetic construct
  misc_feature 1..1931: note = mRNA product Design i-2 comprising derived and/or modified sequence from HRSV(A2)__F-del_DSCav1_mut4 (opt3)
  source 1..1931: mol_type = other RNA
gggagaggcgctgcctacggaggtggcagccatctccttctcggcatcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatatgtagcggagtggcagtctgcaaggtgttgcacctcgagggcgaagttaacaaaatcaagagtgccctgctgtccacgaataaagctgtggtctctctcagcaacggtgtgtccgtattaacttttaaggttctggaccttaagaattacattgataaacaattgctgcctatcctaaacaagcagtcatgtagtattagcaatatcgagaccgtgatagagttccagcagaaaaacaataggctcctggaaattacacgggagttttctgtcaacgccggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgcattataaaggaggaagtgttagcgtatgtagtgcaactgcccctctacggagtcatcgacactccttgttggaaacttcatacaagcccactgtgcaccactaatacaaaggagggctcgaacatttgtttgacccgaacggatcgtggctggtactgcgacaatgcagggtctgtgtccttctttccccaggccgaaacctgtaaggttcagtcaaacagagtgttctgcgatacaatgaatagtagaactctgcctagcgaggtcaacctctgcaatgtggacatctttaacccaaaatatgattgtaagataatgacctccaaaacagacgtatctagctcagttattaccagtctgggagctatcgtgtcctgctacggtaagactaaatgtacagccagcaataagaacaggggcatcattaagaccttctctaatgggtgcgattatgtctcaaacaaaggagtggacactgtcagtgtgggcaatacgctttactgtgttaacaagcaagagggtaaaagcctgtatgtgaagggggaacccatcattaacttttacgaccctttggtattcccatccgatgagtttgacgcatctatatcgcaggtcaatgagaaaatcaaccagagcctcgctttcattcggaagtccgatgaactgttacacaatgtgaacgccggaaagtcaacaaccaatatcatgatcactaccattataatcgttattatcgtgattctgctaagtctcatcgcggtcggcctgcttttgtattgcaaagcccgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5306 - RNA, 1931 nt, synthetic construct
  misc_feature 1..1931: note = mRNA product Design i-2 comprising derived and/or modified sequence from HRSV(A2)__F-del_DSCav1_mut4 (opt4)
  source 1..1931: mol_type = other RNA
gggagaggcgctgcctacggaggtggcagccatctccttctcggcatcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5307 - RNA, 1931 nt, synthetic construct
  misc_feature 1..1931: note = mRNA product Design i-2 comprising derived and/or modified sequence from HRSV(A2)__F-del_DSCav1_mut4 (opt5)
  source 1..1931: mol_type = other RNA
gggagaggcgctgcctacggaggtggcagccatctccttctcggcatcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctatttgttccggcgtcgccgtgtgcaaggttctccacctggagggggaagtgaacaaaatcaagagcgcgcttctgtctaccaataaagccgtcgtgtccctcagcaacggagtttctgtgctgacatttaaggtccttgacctgaagaattacattgataaacaactcctgcctatcctgaacaagcagtcctgtagcatttctaatatcgagaccgtgattgagttccagcagaaaaacaatcggctcctggaaatcacgcgcgagttttccgtgaacgctggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgcatcattaaggaggaagtcctggcctatgtggttcaactccctctgtacggcgtgatcgacacaccctgttggaaactgcatacgtctcctctctgcaccacaaataccaaggaggggtccaacatctgtctgacacggaccgatcgcggatggtactgcgacaatgctggcagcgtctctttctttccccaggccgaaacgtgtaaggtgcagagcaacagagttttctgcgatacaatgaactccagaaccctgccttctgaggtgaatctctgcaatgtcgacatttttaacccgaaatatgattgtaagatcatgaccagcaaaacagacgtgtccagctctgtcattacctccctgggggcgatcgtgagctgctacggaaagacaaaatgtacggcctctaataagaaccggggcattatcaagaccttctccaatgggtgcgattatgttagcaacaaaggagtggacacagtctccgtgggcaataccctttactgtgttaacaagcaagagggcaaatctctgtatgtgaagggggaacccatcattaacttttacgaccctctcgtcttccccagcgatgagtttgacgcttccatctctcaggtgaatgagaaaattaaccagagcctggccttcatccgcaagtccgatgaactgctccacaatgtgaacgctggaaagagcacaaccaatattatgatcacgaccattatcatcgttattatcgtcattctgctttctctgatcgccgtgggcctcctgctgtattgcaaagccagatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5308 - RNA, 1931 nt, synthetic construct
  misc_feature 1..1931: note = mRNA product Design i-2 comprising derived and/or modified sequence from HRSV(A2)__F-del_DSCav1_mut4 (opt6)
  source 1..1931: mol_type = other RNA
gggagaggcgctgcctacggaggtggcagccatctccttctcggcatcaagcttaccatggaacttttaatactaaaagctaacgccataaccactatactaacagcagtcacattctgcttcgcatcaggccaaaacataaccgaagaattttaccaatccacttgttcagcagtctccaaaggatatttatccgcacttcgtacaggatggtatacatcagtaataacaatagaactctccaacataaaagaaaataaatgcaacggcaccgacgcaaaagtaaaactcatcaaacaagaattagacaaatacaagaacgccgtaacagaactacaattactaatgcaatcaacacccgccacaggatcaggatctgcaatatgctctggagtagcagtatgcaaagtattacacctagaaggagaagtaaacaaaatcaaaagcgcactactatccacaaacaaagctgtagtatcactatcaaacggagtatcagtattaactttcaaagtacttgatctaaaaaactacatagacaaacaactactacccatattaaacaaacaatcatgctcaataagcaatatagaaacagtaatagaatttcaacaaaaaaacaacagactactagaaatcacaagggaattttcagtaaatgccggtgttacaaccccagtatcaacatacatgctaactaactcagaactactatccttaataaacgatatgccaataacaaacgatcaaaaaaaactaatgtccaacaacgtacaaatagtaagacaacaatcatactcaatcatgtgcattataaaagaagaagtcttagcatacgtagtacaattaccactatacggtgtaatagatacaccatgttggaaattacacacaagcccactatgcacaactaacacaaaagaaggctcaaatatatgtttaacaagaacagaccgaggttggtactgcgacaatgcaggatcagtatcattctttccacaagcagaaacatgtaaagttcaatccaacagagtattctgcgacacaatgaactccagaacactaccttcagaagtaaacctctgtaacgtagacatatttaatcccaagtacgactgcaaaataatgacatcgaaaacagacgtaagctcctcagtgataacatccctcggcgccatcgtatcctgttacggtaaaactaaatgtaccgcctcaaacaaaaaccgcggtattataaaaactttttctaatggctgcgattacgtaagcaacaaaggcgtcgacacagtttccgtaggaaacacactatactgcgtaaacaaacaagaaggtaaatctctatacgtaaaaggagaaccaataataaatttctatgatcctttagtattcccatccgatgaatttgacgcctctatctcacaagtcaacgaaaaaataaatcaatcattagcattcatacgaaaatcagacgaactactacacaacgtaaacgcaggaaaatcaacaaccaacataatgataaccacaataataatagttattatagtgatactattatccttaattgcagtcggactattattatactgtaaagcacgctaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5309 - RNA, 1931 nt, synthetic construct
  misc_feature 1..1931: note = mRNA product Design i-2 comprising derived and/or modified sequence from HRSV(A2)__F-del_DSCav1_mut4 (opt11)
  source 1..1931: mol_type = other RNA
gggagaggcgctgcctacggaggtggcagccatctccttctcggcatcaagcttaccatggaactcctcatcctcaaagccaatgccatcaccacaatcctgacagcagtaaccttctgcttcgcatccggacaaaacatcaccgaagaattttaccagtcaacctgctccgctgtctcaaaaggctacctctcagcccttcgcaccggctggtacacctcggtcataacaatagaactctccaatatcaaagaaaacaaatgcaacggcactgacgccaaggtaaaactcatcaaacaggaactcgataaatacaagaacgccgtaacagaactacaactactcatgcaatcaacaccggccaccggctccggttccgccatatgctccggagtggccgtgtgcaaggtcctccaccttgaaggggaagttaacaaaatcaaatcagccctcctctccactaacaaagccgtagtatccctaagcaacggtgtatccgtcctcaccttcaaagtactagacctaaagaattatatcgacaaacaactcctccccatactcaacaaacaatcctgctccataagcaacatcgaaacagtcatcgagttccagcagaaaaacaaccgactcctcgaaataacccgcgagttctcagtcaacgccggagtcaccacacccgtcagcacctacatgctgaccaactccgaactcctctccttaatcaatgacatgcccatcaccaatgaccaaaagaaactcatgtcaaacaacgtccaaatagtacgccaacaatcctactccatcatgtgcatcataaaagaagaagtactcgcctacgtcgtccaactccccctctacggcgtaatcgacaccccctgctggaaactacacacaagccccctctgcaccacaaacactaaagagggctccaacatctgtctaacccgcaccgatcgaggctggtactgcgacaacgccggatctgtctcattcttcccccaagccgaaacctgcaaagtccaatccaaccgcgtcttctgcgacaccatgaactcgagaaccctcccttccgaagtcaacctatgcaacgtcgacattttcaaccccaaatacgactgcaaaatcatgacctcgaaaaccgacgtatcatccagcgtcatcaccagcctaggcgcaatcgtgagctgctacggcaaaaccaaatgcaccgcgagcaataaaaaccgcgggatcatcaaaactttctccaacggctgcgactacgtctccaacaagggagtcgataccgtctccgtaggcaacaccctctactgcgtcaacaaacaagaaggcaaatcactatacgtaaaaggcgagccaatcataaacttctacgaccctctagttttcccatccgacgagttcgacgctagcatctcccaagtcaacgagaaaatcaaccaatccctcgcattcatccgcaaatccgacgaactcctccacaacgtaaacgcaggcaaatcaactactaatataatgatcacaaccatcataatagtcataatcgtaatcctcctatccctcatcgccgtcggactactgctctactgcaaagcccgctaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5310 - RNA, 1927 nt, synthetic construct
  misc_feature 1..1927: note = mRNA product Design i-2 comprising derived and/or modified sequence from HRSV(A2)__F-del_DSCav1_mut4 (opt1)
  source 1..1927: mol_type = other RNA
ggggcgctgcctacggaggtggcagccatctccttctcggcatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5311 - RNA, 1927 nt, synthetic construct
  misc_feature 1..1927: note = mRNA product Design i-2 comprising derived and/or modified sequence from HRSV(A2)__F-del_DSCav1_mut4 (opt1)
  source 1..1927: mol_type = other RNA
ggggcgctgcctacggaggtggcagccatctccttctcggcatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatctgcagcggcgtggccgtgtgcaaggtcctgcacctcgagggcgaggtgaacaagatcaagtccgcgctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgccggctccgtgagcttcttcccccaggcggagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactgcgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgccttcatccgcaagagcgacgagctgctgcacaacgtgaacgcggggaagtccaccaccaacatcatgatcaccacgatcatcatcgtgatcatcgtcatcctcctgagcctgatcgccgtgggcctcctgctgtactgcaaggcccggtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5312 - RNA, 1927 nt, synthetic construct
  misc_feature 1..1927: note = mRNA product Design i-2 comprising derived and/or modified sequence from HRSV(A2)__F-del_DSCav1_mut4 (opt2)
  source 1..1927: mol_type = other RNA
ggggcgctgcctacggaggtggcagccatctccttctcggcatcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5313 - RNA, 1927 nt, synthetic construct
  misc_feature 1..1927: note = mRNA product Design i-2 comprising derived and/or modified sequence from HRSV(A2)__F-del_DSCav1_mut4 (opt3)
  source 1..1927: mol_type = other RNA
ggggcgctgcctacggaggtggcagccatctccttctcggcatcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatatgtagcggagtggcagtctgcaaggtgttgcacctcgagggcgaagttaacaaaatcaagagtgccctgctgtccacgaataaagctgtggtctctctcagcaacggtgtgtccgtattaacttttaaggttctggaccttaagaattacattgataaacaattgctgcctatcctaaacaagcagtcatgtagtattagcaatatcgagaccgtgatagagttccagcagaaaaacaataggctcctggaaattacacgggagttttctgtcaacgccggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgcattataaaggaggaagtgttagcgtatgtagtgcaactgcccctctacggagtcatcgacactccttgttggaaacttcatacaagcccactgtgcaccactaatacaaaggagggctcgaacatttgtttgacccgaacggatcgtggctggtactgcgacaatgcagggtctgtgtccttctttccccaggccgaaacctgtaaggttcagtcaaacagagtgttctgcgatacaatgaatagtagaactctgcctagcgaggtcaacctctgcaatgtggacatctttaacccaaaatatgattgtaagataatgacctccaaaacagacgtatctagctcagttattaccagtctgggagctatcgtgtcctgctacggtaagactaaatgtacagccagcaataagaacaggggcatcattaagaccttctctaatgggtgcgattatgtctcaaacaaaggagtggacactgtcagtgtgggcaatacgctttactgtgttaacaagcaagagggtaaaagcctgtatgtgaagggggaacccatcattaacttttacgaccctttggtattcccatccgatgagtttgacgcatctatatcgcaggtcaatgagaaaatcaaccagagcctcgctttcattcggaagtccgatgaactgttacacaatgtgaacgccggaaagtcaacaaccaatatcatgatcactaccattataatcgttattatcgtgattctgctaagtctcatcgcggtcggcctgcttttgtattgcaaagcccgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5314 - RNA, 1927 nt, synthetic construct
  misc_feature 1..1927: note = mRNA product Design i-2 comprising derived and/or modified sequence from HRSV(A2)__F-del_DSCav1_mut4 (opt4)
  source 1..1927: mol_type = other RNA
ggggcgctgcctacggaggtggcagccatctccttctcggcatcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5315 - RNA, 1927 nt, synthetic construct
  misc_feature 1..1927: note = mRNA product Design i-2 comprising derived and/or modified sequence from HRSV(A2)__F-del_DSCav1_mut4 (opt5)
  source 1..1927: mol_type = other RNA
ggggcgctgcctacggaggtggcagccatctccttctcggcatcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctatttgttccggcgtcgccgtgtgcaaggttctccacctggagggggaagtgaacaaaatcaagagcgcgcttctgtctaccaataaagccgtcgtgtccctcagcaacggagtttctgtgctgacatttaaggtccttgacctgaagaattacattgataaacaactcctgcctatcctgaacaagcagtcctgtagcatttctaatatcgagaccgtgattgagttccagcagaaaaacaatcggctcctggaaatcacgcgcgagttttccgtgaacgctggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgcatcattaaggaggaagtcctggcctatgtggttcaactccctctgtacggcgtgatcgacacaccctgttggaaactgcatacgtctcctctctgcaccacaaataccaaggaggggtccaacatctgtctgacacggaccgatcgcggatggtactgcgacaatgctggcagcgtctctttctttccccaggccgaaacgtgtaaggtgcagagcaacagagttttctgcgatacaatgaactccagaaccctgccttctgaggtgaatctctgcaatgtcgacatttttaacccgaaatatgattgtaagatcatgaccagcaaaacagacgtgtccagctctgtcattacctccctgggggcgatcgtgagctgctacggaaagacaaaatgtacggcctctaataagaaccggggcattatcaagaccttctccaatgggtgcgattatgttagcaacaaaggagtggacacagtctccgtgggcaataccctttactgtgttaacaagcaagagggcaaatctctgtatgtgaagggggaacccatcattaacttttacgaccctctcgtcttccccagcgatgagtttgacgcttccatctctcaggtgaatgagaaaattaaccagagcctggccttcatccgcaagtccgatgaactgctccacaatgtgaacgctggaaagagcacaaccaatattatgatcacgaccattatcatcgttattatcgtcattctgctttctctgatcgccgtgggcctcctgctgtattgcaaagccagatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5316 - RNA, 1927 nt, synthetic construct
  misc_feature 1..1927: note = mRNA product Design i-2 comprising derived and/or modified sequence from HRSV(A2)__F-del_DSCav1_mut4 (opt6)
  source 1..1927: mol_type = other RNA
ggggcgctgcctacggaggtggcagccatctccttctcggcatcaagcttaccatggaacttttaatactaaaagctaacgccataaccactatactaacagcagtcacattctgcttcgcatcaggccaaaacataaccgaagaattttaccaatccacttgttcagcagtctccaaaggatatttatccgcacttcgtacaggatggtatacatcagtaataacaatagaactctccaacataaaagaaaataaatgcaacggcaccgacgcaaaagtaaaactcatcaaacaagaattagacaaatacaagaacgccgtaacagaactacaattactaatgcaatcaacacccgccacaggatcaggatctgcaatatgctctggagtagcagtatgcaaagtattacacctagaaggagaagtaaacaaaatcaaaagcgcactactatccacaaacaaagctgtagtatcactatcaaacggagtatcagtattaactttcaaagtacttgatctaaaaaactacatagacaaacaactactacccatattaaacaaacaatcatgctcaataagcaatatagaaacagtaatagaatttcaacaaaaaaacaacagactactagaaatcacaagggaattttcagtaaatgccggtgttacaaccccagtatcaacatacatgctaactaactcagaactactatccttaataaacgatatgccaataacaaacgatcaaaaaaaactaatgtccaacaacgtacaaatagtaagacaacaatcatactcaatcatgtgcattataaaagaagaagtcttagcatacgtagtacaattaccactatacggtgtaatagatacaccatgttggaaattacacacaagcccactatgcacaactaacacaaaagaaggctcaaatatatgtttaacaagaacagaccgaggttggtactgcgacaatgcaggatcagtatcattctttccacaagcagaaacatgtaaagttcaatccaacagagtattctgcgacacaatgaactccagaacactaccttcagaagtaaacctctgtaacgtagacatatttaatcccaagtacgactgcaaaataatgacatcgaaaacagacgtaagctcctcagtgataacatccctcggcgccatcgtatcctgttacggtaaaactaaatgtaccgcctcaaacaaaaaccgcggtattataaaaactttttctaatggctgcgattacgtaagcaacaaaggcgtcgacacagtttccgtaggaaacacactatactgcgtaaacaaacaagaaggtaaatctctatacgtaaaaggagaaccaataataaatttctatgatcctttagtattcccatccgatgaatttgacgcctctatctcacaagtcaacgaaaaaataaatcaatcattagcattcatacgaaaatcagacgaactactacacaacgtaaacgcaggaaaatcaacaaccaacataatgataaccacaataataatagttattatagtgatactattatccttaattgcagtcggactattattatactgtaaagcacgctaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5317 - RNA, 1927 nt, synthetic construct
  misc_feature 1..1927: note = mRNA product Design i-2 comprising derived and/or modified sequence from HRSV(A2)__F-del_DSCav1_mut4 (opt11)
  source 1..1927: mol_type = other RNA
ggggcgctgcctacggaggtggcagccatctccttctcggcatcaagcttaccatggaactcctcatcctcaaagccaatgccatcaccacaatcctgacagcagtaaccttctgcttcgcatccggacaaaacatcaccgaagaattttaccagtcaacctgctccgctgtctcaaaaggctacctctcagcccttcgcaccggctggtacacctcggtcataacaatagaactctccaatatcaaagaaaacaaatgcaacggcactgacgccaaggtaaaactcatcaaacaggaactcgataaatacaagaacgccgtaacagaactacaactactcatgcaatcaacaccggccaccggctccggttccgccatatgctccggagtggccgtgtgcaaggtcctccaccttgaaggggaagttaacaaaatcaaatcagccctcctctccactaacaaagccgtagtatccctaagcaacggtgtatccgtcctcaccttcaaagtactagacctaaagaattatatcgacaaacaactcctccccatactcaacaaacaatcctgctccataagcaacatcgaaacagtcatcgagttccagcagaaaaacaaccgactcctcgaaataacccgcgagttctcagtcaacgccggagtcaccacacccgtcagcacctacatgctgaccaactccgaactcctctccttaatcaatgacatgcccatcaccaatgaccaaaagaaactcatgtcaaacaacgtccaaatagtacgccaacaatcctactccatcatgtgcatcataaaagaagaagtactcgcctacgtcgtccaactccccctctacggcgtaatcgacaccccctgctggaaactacacacaagccccctctgcaccacaaacactaaagagggctccaacatctgtctaacccgcaccgatcgaggctggtactgcgacaacgccggatctgtctcattcttcccccaagccgaaacctgcaaagtccaatccaaccgcgtcttctgcgacaccatgaactcgagaaccctcccttccgaagtcaacctatgcaacgtcgacattttcaaccccaaatacgactgcaaaatcatgacctcgaaaaccgacgtatcatccagcgtcatcaccagcctaggcgcaatcgtgagctgctacggcaaaaccaaatgcaccgcgagcaataaaaaccgcgggatcatcaaaactttctccaacggctgcgactacgtctccaacaagggagtcgataccgtctccgtaggcaacaccctctactgcgtcaacaaacaagaaggcaaatcactatacgtaaaaggcgagccaatcataaacttctacgaccctctagttttcccatccgacgagttcgacgctagcatctcccaagtcaacgagaaaatcaaccaatccctcgcattcatccgcaaatccgacgaactcctccacaacgtaaacgcaggcaaatcaactactaatataatgatcacaaccatcataatagtcataatcgtaatcctcctatccctcatcgccgtcggactactgctctactgcaaagcccgctaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5318 - RNA, 1762 nt, synthetic construct
  misc_feature 1..1762: note = mRNA product Design i-3 comprising derived and/or modified sequence from HRSV(A2)__F-del_DSCav1_mut4 (opt1) R7459
  source 1..1762: mol_type = other RNA
gggagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5319 - RNA, 1762 nt, synthetic construct
  misc_feature 1..1762: note = mRNA product Design i-3 comprising derived and/or modified sequence from HRSV(A2)__F-del_DSCav1_mut4 (opt1)
  source 1..1762: mol_type = other RNA
gggagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatctgcagcggcgtggccgtgtgcaaggtcctgcacctcgagggcgaggtgaacaagatcaagtccgcgctgctgagcaccaacaaggccgtggtctccctcagcaacggggtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggcgtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggggtgatcgacacgccgtgctggaagctgcacaccagccccctctgcaccaccaacacgaaggagggctccaacatctgcctgacccgcaccgaccgggggtggtactgcgacaacgccggctccgtgagcttcttcccccaggcggagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggcgccatcgtgtcctgctacgggaagaccaagtgcaccgccagcaacaagaaccggggcatcatcaagaccttctccaacgggtgcgactacgtgagcaacaagggcgtcgacacggtgagcgtgggcaacaccctctactgcgtcaacaagcaggaggggaagtccctgtacgtgaagggcgagcccatcatcaacttctacgaccccctggtgttccccagcgacgagttcgacgcctccatcagccaggtcaacgagaagatcaaccagtccctcgccttcatccgcaagagcgacgagctgctgcacaacgtgaacgcggggaagtccaccaccaacatcatgatcaccacgatcatcatcgtgatcatcgtcatcctcctgagcctgatcgccgtgggcctcctgctgtactgcaaggcccggtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5320 - RNA, 1762 nt, synthetic construct
  misc_feature 1..1762: note = mRNA product Design i-3 comprising derived and/or modified sequence from HRSV(A2)__F-del_DSCav1_mut4 (opt2)
  source 1..1762: mol_type = other RNA
gggagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5321 - RNA, 1762 nt, synthetic construct
  misc_feature 1..1762: note = mRNA product Design i-3 comprising derived and/or modified sequence from HRSV(A2)__F-del_DSCav1_mut4 (opt3)
  source 1..1762: mol_type = other RNA
gggagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatatgtagcggagtggcagtctgcaaggtgttgcacctcgagggcgaagttaacaaaatcaagagtgccctgctgtccacgaataaagctgtggtctctctcagcaacggtgtgtccgtattaacttttaaggttctggaccttaagaattacattgataaacaattgctgcctatcctaaacaagcagtcatgtagtattagcaatatcgagaccgtgatagagttccagcagaaaaacaataggctcctggaaattacacgggagttttctgtcaacgccggggtgactaccccagtgtccacatatatgcttaccaattcagaactgttgagcctcatcaacgacatgccgattacgaacgatcaaaagaaactgatgagtaataacgtccagatcgttcgccagcagtcttactccatcatgtgcattataaaggaggaagtgttagcgtatgtagtgcaactgcccctctacggagtcatcgacactccttgttggaaacttcatacaagcccactgtgcaccactaatacaaaggagggctcgaacatttgtttgacccgaacggatcgtggctggtactgcgacaatgcagggtctgtgtccttctttccccaggccgaaacctgtaaggttcagtcaaacagagtgttctgcgatacaatgaatagtagaactctgcctagcgaggtcaacctctgcaatgtggacatctttaacccaaaatatgattgtaagataatgacctccaaaacagacgtatctagctcagttattaccagtctgggagctatcgtgtcctgctacggtaagactaaatgtacagccagcaataagaacaggggcatcattaagaccttctctaatgggtgcgattatgtctcaaacaaaggagtggacactgtcagtgtgggcaatacgctttactgtgttaacaagcaagagggtaaaagcctgtatgtgaagggggaacccatcattaacttttacgaccctttggtattcccatccgatgagtttgacgcatctatatcgcaggtcaatgagaaaatcaaccagagcctcgctttcattcggaagtccgatgaactgttacacaatgtgaacgccggaaagtcaacaaccaatatcatgatcactaccattataatcgttattatcgtgattctgctaagtctcatcgcggtcggcctgcttttgtattgcaaagcccgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5322 - RNA, 1762 nt, synthetic construct
  misc_feature 1..1762: note = mRNA product Design i-3 comprising derived and/or modified sequence from HRSV(A2)__F-del_DSCav1_mut4 (opt4)
  source 1..1762: mol_type = other RNA
gggagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5323 - RNA, 1762 nt, synthetic construct
  misc_feature 1..1762: note = mRNA product Design i-3 comprising derived and/or modified sequence from HRSV(A2)__F-del_DSCav1_mut4 (opt5)
  source 1..1762: mol_type = other RNA
gggagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctatttgttccggcgtcgccgtgtgcaaggttctccacctggagggggaagtgaacaaaatcaagagcgcgcttctgtctaccaataaagccgtcgtgtccctcagcaacggagtttctgtgctgacatttaaggtccttgacctgaagaattacattgataaacaactcctgcctatcctgaacaagcagtcctgtagcatttctaatatcgagaccgtgattgagttccagcagaaaaacaatcggctcctggaaatcacgcgcgagttttccgtgaacgctggcgtcacaaccccggttagcacatatatgcttaccaattccgaactgctctctctgatcaacgacatgcccattaccaacgatcaaaagaaacttatgagcaataacgtgcagatcgtgagacagcagtcctacagcattatgtgcatcattaaggaggaagtcctggcctatgtggttcaactccctctgtacggcgtgatcgacacaccctgttggaaactgcatacgtctcctctctgcaccacaaataccaaggaggggtccaacatctgtctgacacggaccgatcgcggatggtactgcgacaatgctggcagcgtctctttctttccccaggccgaaacgtgtaaggtgcagagcaacagagttttctgcgatacaatgaactccagaaccctgccttctgaggtgaatctctgcaatgtcgacatttttaacccgaaatatgattgtaagatcatgaccagcaaaacagacgtgtccagctctgtcattacctccctgggggcgatcgtgagctgctacggaaagacaaaatgtacggcctctaataagaaccggggcattatcaagaccttctccaatgggtgcgattatgttagcaacaaaggagtggacacagtctccgtgggcaataccctttactgtgttaacaagcaagagggcaaatctctgtatgtgaagggggaacccatcattaacttttacgaccctctcgtcttccccagcgatgagtttgacgcttccatctctcaggtgaatgagaaaattaaccagagcctggccttcatccgcaagtccgatgaactgctccacaatgtgaacgctggaaagagcacaaccaatattatgatcacgaccattatcatcgttattatcgtcattctgctttctctgatcgccgtgggcctcctgctgtattgcaaagccagatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5324 - RNA, 1762 nt, synthetic construct
  misc_feature 1..1762: note = mRNA product Design i-3 comprising derived and/or modified sequence from HRSV(A2)__F-del_DSCav1_mut4 (opt6)
  source 1..1762: mol_type = other RNA
gggagaaagcttaccatggaacttttaatactaaaagctaacgccataaccactatactaacagcagtcacattctgcttcgcatcaggccaaaacataaccgaagaattttaccaatccacttgttcagcagtctccaaaggatatttatccgcacttcgtacaggatggtatacatcagtaataacaatagaactctccaacataaaagaaaataaatgcaacggcaccgacgcaaaagtaaaactcatcaaacaagaattagacaaatacaagaacgccgtaacagaactacaattactaatgcaatcaacacccgccacaggatcaggatctgcaatatgctctggagtagcagtatgcaaagtattacacctagaaggagaagtaaacaaaatcaaaagcgcactactatccacaaacaaagctgtagtatcactatcaaacggagtatcagtattaactttcaaagtacttgatctaaaaaactacatagacaaacaactactacccatattaaacaaacaatcatgctcaataagcaatatagaaacagtaatagaatttcaacaaaaaaacaacagactactagaaatcacaagggaattttcagtaaatgccggtgttacaaccccagtatcaacatacatgctaactaactcagaactactatccttaataaacgatatgccaataacaaacgatcaaaaaaaactaatgtccaacaacgtacaaatagtaagacaacaatcatactcaatcatgtgcattataaaagaagaagtcttagcatacgtagtacaattaccactatacggtgtaatagatacaccatgttggaaattacacacaagcccactatgcacaactaacacaaaagaaggctcaaatatatgtttaacaagaacagaccgaggttggtactgcgacaatgcaggatcagtatcattctttccacaagcagaaacatgtaaagttcaatccaacagagtattctgcgacacaatgaactccagaacactaccttcagaagtaaacctctgtaacgtagacatatttaatcccaagtacgactgcaaaataatgacatcgaaaacagacgtaagctcctcagtgataacatccctcggcgccatcgtatcctgttacggtaaaactaaatgtaccgcctcaaacaaaaaccgcggtattataaaaactttttctaatggctgcgattacgtaagcaacaaaggcgtcgacacagtttccgtaggaaacacactatactgcgtaaacaaacaagaaggtaaatctctatacgtaaaaggagaaccaataataaatttctatgatcctttagtattcccatccgatgaatttgacgcctctatctcacaagtcaacgaaaaaataaatcaatcattagcattcatacgaaaatcagacgaactactacacaacgtaaacgcaggaaaatcaacaaccaacataatgataaccacaataataatagttattatagtgatactattatccttaattgcagtcggactattattatactgtaaagcacgctaaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5325 - RNA, 1762 nt, synthetic construct
  misc_feature 1..1762: note = mRNA product Design i-3 comprising derived and/or modified sequence from HRSV(A2)__F-del_DSCav1_mut4 (opt11)
  source 1..1762: mol_type = other RNA
gggagaaagcttaccatggaactcctcatcctcaaagccaatgccatcaccacaatcctgacagcagtaaccttctgcttcgcatccggacaaaacatcaccgaagaattttaccagtcaacctgctccgctgtctcaaaaggctacctctcagcccttcgcaccggctggtacacctcggtcataacaatagaactctccaatatcaaagaaaacaaatgcaacggcactgacgccaaggtaaaactcatcaaacaggaactcgataaatacaagaacgccgtaacagaactacaactactcatgcaatcaacaccggccaccggctccggttccgccatatgctccggagtggccgtgtgcaaggtcctccaccttgaaggggaagttaacaaaatcaaatcagccctcctctccactaacaaagccgtagtatccctaagcaacggtgtatccgtcctcaccttcaaagtactagacctaaagaattatatcgacaaacaactcctccccatactcaacaaacaatcctgctccataagcaacatcgaaacagtcatcgagttccagcagaaaaacaaccgactcctcgaaataacccgcgagttctcagtcaacgccggagtcaccacacccgtcagcacctacatgctgaccaactccgaactcctctccttaatcaatgacatgcccatcaccaatgaccaaaagaaactcatgtcaaacaacgtccaaatagtacgccaacaatcctactccatcatgtgcatcataaaagaagaagtactcgcctacgtcgtccaactccccctctacggcgtaatcgacaccccctgctggaaactacacacaagccccctctgcaccacaaacactaaagagggctccaacatctgtctaacccgcaccgatcgaggctggtactgcgacaacgccggatctgtctcattcttcccccaagccgaaacctgcaaagtccaatccaaccgcgtcttctgcgacaccatgaactcgagaaccctcccttccgaagtcaacctatgcaacgtcgacattttcaaccccaaatacgactgcaaaatcatgacctcgaaaaccgacgtatcatccagcgtcatcaccagcctaggcgcaatcgtgagctgctacggcaaaaccaaatgcaccgcgagcaataaaaaccgcgggatcatcaaaactttctccaacggctgcgactacgtctccaacaagggagtcgataccgtctccgtaggcaacaccctctactgcgtcaacaaacaagaaggcaaatcactatacgtaaaaggcgagccaatcataaacttctacgaccctctagttttcccatccgacgagttcgacgctagcatctcccaagtcaacgagaaaatcaaccaatccctcgcattcatccgcaaatccgacgaactcctccacaacgtaaacgcaggcaaatcaactactaatataatgatcacaaccatcataatagtcataatcgtaatcctcctatccctcatcgccgtcggactactgctctactgcaaagcccgctaaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5326 - protein, 536 aa, synthetic construct
  REGION 1..536: note = derived and/or modified protein sequence (artificial) from HRSV(A2)__F_DSCav1_mut5
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATGSGSAIASGVAVCKVLHLEGEVNKIKSALLSTNKAVVSLSGCGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKCRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 5327 - RNA, 1611 nt, synthetic construct
  misc_feature 1..1611: note = derived and/or modified CDS sequence (opt1) from HRSV(A2)__F_DSCav1_mut5
  source 1..1611: mol_type = other RNA
atggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactga

SEQ ID NO: 5328 - RNA, 1611 nt, synthetic construct
  misc_feature 1..1611: note = derived and/or modified CDS sequence (opt1) from HRSV(A2)__F_DSCav1_mut5
  source 1..1611: mol_type = other RNA
atggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcgggtgcggcgtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggggtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggcgtgatcgacacgccgtgctggaagctgcacaccagccccctctgcaccaccaacacgaaggaggggtccaacatctgcctgacccgcaccgaccggggctggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggggccatcgtgtcctgctacggcaagaccaagtgcaccgccagcaacaagtgccgggggatcatcaagaccttctccaacggctgcgactacgtgagcaacaagggcgtcgacacggtgagcgtggggaacaccctctactacgtcaacaagcaggagggcaagtccctgtacgtgaagggggagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccggcaagtccaccaccaacatcatgatcaccacgatcatcatcgtgatcatcgtcatcctcctgagcctgatcgccgtggggctcctgctgtactgcaaggcccggtccaccccggtgaccctgagcaaggaccagctctccggcatcaacaacatcgccttcagcaactga

SEQ ID NO: 5329 - RNA, 1611 nt, synthetic construct
  misc_feature 1..1611: note = derived and/or modified CDS sequence (opt2) from HRSV(A2)__F_DSCav1_mut5
  source 1..1611: mol_type = other RNA
atggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactga

SEQ ID NO: 5330 - RNA, 1611 nt, synthetic construct
  misc_feature 1..1611: note = derived and/or modified CDS sequence (opt3) from HRSV(A2)__F_DSCav1_mut5
  source 1..1611: mol_type = other RNA
atggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcggttgcggggtgtccgtattaacttttaaggttctggaccttaagaactacattgataaacaattgctgcctatcctaaataagcagtcatgtagtattagcaacatcgagaccgtgatagagttccagcagaaaaataacaggctcctggaaattacacgggagttttctgtcaatgcgggagtgactaccccagtgtccacatatatgcttaccaactcagaactgttgagcctcatcaatgacatgccgattacgaacgatcaaaagaaactgatgagtaacaatgtccagatcgttcgccagcagtcttactccatcatgtgcattataaaggaggaagtgttagcatatgtagtgcaactgcccctctacggcgtcatcgacactccttgttggaaacttcatacaagcccactgtgcaccactaacacaaaggagggctcgaatatttgtttgacccgaacggatcgtgggtggtactgcgacaacgccggatctgtgtccttctttccccaggctgaaacctgtaaggttcagtcaaatagagtgttctgcgatacaatgaacagtagaactctgcctagcgaggtcaatctctgcaacgtggacatctttaatccaaaatatgattgtaagataatgacctccaaaacagacgtatctagctcagttattaccagtctgggtgccatcgtgtcctgctacggcaagactaaatgtacagcaagcaacaagtgcagggggatcattaagaccttctctaatggatgtgattatgtctcaaacaaaggcgtggacactgtcagtgtgggtaatacgctttactatgttaacaagcaagaggggaaaagcctgtacgtgaagggagaacccatcattaatttttatgaccctttggtattcccatccgatgagtttgacgcttctatatcgcaggtcaacgagaaaatcaaccagagcctcgccttcattcggaagtccgatgaactgttacacaatgtgaacgcgggcaagtcaacaaccaatatcatgatcactaccattataatcgttattatcgtgattctgctaagtctcatcgccgtcggcctgcttttgtactgcaaagcacgctctacaccggtgaccctgagcaaggaccagctctccgggataaacaatatcgctttctcaaactga

SEQ ID NO: 5331 - RNA, 1611 nt, synthetic construct
  misc_feature 1..1611: note = derived and/or modified CDS sequence (opt4) from HRSV(A2)__F_DSCav1_mut5
  source 1..1611: mol_type = other RNA
atggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactga

SEQ ID NO: 5332 - RNA, 1611 nt, synthetic construct
  misc_feature 1..1611: note = derived and/or modified CDS sequence (opt5) from HRSV(A2)__F_DSCav1_mut5
  source 1..1611: mol_type = other RNA
atggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcggatgcggcgtttctgtgctgacatttaaggtccttgacctgaagaactacattgataaacaactcctgcctatcctgaataagcagtcctgtagcatttctaacatcgagaccgtgattgagttccagcagaaaaataaccggctcctggaaatcacgcgcgagttttccgtgaatgccggcgtcacaaccccggttagcacatatatgcttaccaactccgaactgctctctctgatcaatgacatgcccattaccaacgatcaaaagaaacttatgagcaacaatgtgcagatcgtgagacagcagtcctacagcattatgtgcatcattaaggaggaagtcctggcttatgtggttcaactccctctgtacggggtgatcgacacaccctgttggaaactgcatacgtctcctctctgcaccacaaacaccaaggagggatccaatatctgtctgacacggaccgatcgcggctggtactgcgacaacgccgggagcgtctctttctttccccaggcggaaacgtgtaaggtgcagagcaatagagttttctgcgatacaatgaactccagaaccctgccttctgaggtgaatctctgcaacgtcgacatttttaatccgaaatatgattgtaagatcatgaccagcaaaacagacgtgtccagctctgtcattacctccctgggagccatcgtgagctgctacggcaagacaaaatgtacggcttctaacaagtgccgggggattatcaagaccttctccaatggatgtgattatgttagcaacaaaggcgtggacacagtctccgtgggcaataccctttactatgttaacaagcaagaggggaaatctctgtacgtgaagggagaacccatcattaatttttatgaccctctcgtcttccccagcgatgagtttgacgcctccatctctcaggtgaacgagaaaattaaccagagcctggctttcatccgcaagtccgatgaactgctccacaatgtgaacgccggcaagagcacaaccaatattatgatcacgaccattatcatcgttattatcgtcattctgctttctctgatcgccgtggggctcctgctgtactgcaaagctagatccacacctgtgacccttagcaaggaccagctctctggaattaacaatatcgcgttctccaactga

SEQ ID NO: 5333 - RNA, 1611 nt, synthetic construct
  misc_feature 1..1611: note = derived and/or modified CDS sequence (opt6) from HRSV(A2)__F_DSCav1_mut5
  source 1..1611: mol_type = other RNA
atggaactattaatacttaaagccaacgcaataacaacaattctcactgctgtcaccttctgcttcgcctcaggccaaaacataacggaagaattttaccaatcaacatgctctgcagtatccaaaggctacctatctgctctaagaacaggttggtatacatcagtaataaccatagaactatcaaacataaaagaaaataaatgcaacggaacagacgcaaaagttaaactcataaaacaagaactagacaaatataaaaacgcagttaccgaactacaactacttatgcaatccactcccgccactggatcaggatcagcaatagcatcaggagtcgcagtatgtaaagtcttacacctcgaaggcgaagtcaataaaatcaaatccgcattactatccacaaacaaagcagtcgtatccctaagcggatgcggagtatcagtactaacatttaaagtactagacctaaaaaattacatcgataaacaactattacctatattaaacaaacaatcctgctccatttcaaatatcgaaaccgtaatagaatttcaacaaaaaaacaacagattactagaaataacaagagaattttccgtaaatgctggcgtaacaacaccagtatccacatacatgctcacaaactccgaactactatcactaataaatgacatgcccataacaaacgatcaaaaaaaactaatgtcaaataatgtacaaatagtaagacaacaaagctactccatcatgtgtataataaaagaagaagtactagcatacgtagttcaactaccactttacggcgtaatcgacaccccttgctggaaactacacacctcccctctatgcaccacaaacacaaaagaaggttccaacatatgccttaccagaacagacagaggctggtattgcgacaacgcaggatcagtttcattttttccacaagctgaaacatgcaaagtacaatcaaacagagtcttctgcgacacaatgaactcaagaactctaccctcagaagtaaacctatgtaacgtagacattttcaaccccaaatacgactgcaaaattatgacatcaaaaacagacgtttcatcatcagttatcacctcattaggagcaatagtaagctgctacggaaaaacaaaatgcaccgcctcaaataaatgcagaggaataataaaaactttctccaacggatgcgactacgtttcaaacaaaggtgtagacactgtatcagtaggaaacacactatattacgtaaataaacaagaaggaaaatcactttatgtcaaaggagaaccaataatcaatttctacgacccattagtattcccatcagacgaatttgatgcttcaatatcacaagtaaacgaaaaaataaatcaatcactcgcatttatacgaaaatcagacgaactactacacaatgtaaacgcaggcaaatcaacaacaaacataatgataacaacaataatcattgtaataatagtaatacttctatctctaatagcagtaggattactcctctactgcaaagcaagatcaacccctgtaacactatcaaaagaccaactttcaggtataaataatatagctttttccaattaa

SEQ ID NO: 5334 - RNA, 1611 nt, synthetic construct
  misc_feature 1..1611: note = derived and/or modified CDS sequence (opt11) from HRSV(A2)__F_DSCav1_mut5
  source 1..1611: mol_type = other RNA
atggagctcctaatcctcaaagccaacgcgatcactacaatcctcacagccgtcaccttctgcttcgcctccggccaaaacatcaccgaggagttctaccaatcaacctgctccgccgtatcaaaaggatacctaagcgccctacggaccggctggtacacatctgtcatcaccatcgaactatcaaacatcaaagaaaacaaatgcaacggaaccgacgcaaaagtcaaactgattaaacaagaactagacaaatacaaaaacgcagtcaccgaactgcaattactcatgcaaagcacaccggccaccggctcaggcagcgccatcgcctccggcgtcgccgtctgcaaagttctccacctcgagggcgaagtcaacaaaataaaatctgccctcctctccaccaacaaagccgtcgtctccctcagcggctgcggagtctccgtcctcaccttcaaagttctcgatctcaagaactatattgacaaacaacttctacccatactcaacaaacaaagctgcagcatatccaacatcgaaaccgtcatcgagttccaacaaaagaacaaccgcctcctcgaaataacccgcgagttcagcgttaacgccggagtcactacccctgtctccacctacatgctcaccaactccgaactcctatcactaatcaacgacatgcccataaccaacgaccagaagaaactcatgtccaacaacgtccaaattgtccgacaacaaagctactccataatgtgcataataaaagaggaagtcctcgcctacgtcgtacaactgcccctttatggcgtaatcgacacaccctgctggaaactccacacgtcacccctctgcaccaccaacacaaaagaaggctcgaacatctgcctaacacggactgaccgcggctggtactgcgacaacgccggctccgtcagcttcttcccacaagccgaaacctgcaaagtacaatccaaccgagtattctgcgacaccatgaactccagaaccctcccctcagaggtcaacctgtgcaacgtagacatcttcaaccccaaatacgactgcaaaataatgacctcaaaaacagacgtctcctcttccgtaatcaccagcctcggagccatcgtcagctgctacggcaaaaccaaatgcaccgcctcaaacaaatgccgcggcatcatcaaaacattctcaaacggctgcgactacgtctccaacaaaggcgtcgacacagtaagcgtaggcaacacactgtactacgtcaacaaacaagagggaaaatcactctacgtcaaaggagaacccataatcaacttctacgaccccctcgttttccccagcgacgagttcgacgccagcatatcccaagtcaacgagaaaattaaccaatccctagcattcatccgaaaatctgacgaactgctccacaacgtcaacgcgggaaaatcaacaaccaacataatgataaccacaatcataatagtcatcatcgtaatcctcctcagcctaatcgctgtcggcctcctcctctactgcaaagcccgttccaccccagtcacactttccaaggaccaactaagcggaataaacaacatcgcgttctcaaactaa

SEQ ID NO: 5335 - RNA, 1887 nt, synthetic construct
  misc_feature 1..1887: note = mRNA product Design a-1 comprising derived and/or modified sequence from HRSV(A2)__F_DSCav1_mut5 (opt1)
  source 1..1887: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5336 - RNA, 1887 nt, synthetic construct
  misc_feature 1..1887: note = mRNA product Design a-1 comprising derived and/or modified sequence from HRSV(A2)__F_DSCav1_mut5 (opt1)
  source 1..1887: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcgggtgcggcgtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggggtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggcgtgatcgacacgccgtgctggaagctgcacaccagccccctctgcaccaccaacacgaaggaggggtccaacatctgcctgacccgcaccgaccggggctggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggggccatcgtgtcctgctacggcaagaccaagtgcaccgccagcaacaagtgccgggggatcatcaagaccttctccaacggctgcgactacgtgagcaacaagggcgtcgacacggtgagcgtggggaacaccctctactacgtcaacaagcaggagggcaagtccctgtacgtgaagggggagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccggcaagtccaccaccaacatcatgatcaccacgatcatcatcgtgatcatcgtcatcctcctgagcctgatcgccgtggggctcctgctgtactgcaaggcccggtccaccccggtgaccctgagcaaggaccagctctccggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5337 - RNA, 1887 nt, synthetic construct
  misc_feature 1..1887: note = mRNA product Design a-1 comprising derived and/or modified sequence from HRSV(A2)__F_DSCav1_mut5 (opt2)
  source 1..1887: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5338 - RNA, 1887 nt, synthetic construct
  misc_feature 1..1887: note = mRNA product Design a-1 comprising derived and/or modified sequence from HRSV(A2)__F_DSCav1_mut5 (opt3)
  source 1..1887: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcggttgcggggtgtccgtattaacttttaaggttctggaccttaagaactacattgataaacaattgctgcctatcctaaataagcagtcatgtagtattagcaacatcgagaccgtgatagagttccagcagaaaaataacaggctcctggaaattacacgggagttttctgtcaatgcgggagtgactaccccagtgtccacatatatgcttaccaactcagaactgttgagcctcatcaatgacatgccgattacgaacgatcaaaagaaactgatgagtaacaatgtccagatcgttcgccagcagtcttactccatcatgtgcattataaaggaggaagtgttagcatatgtagtgcaactgcccctctacggcgtcatcgacactccttgttggaaacttcatacaagcccactgtgcaccactaacacaaaggagggctcgaatatttgtttgacccgaacggatcgtgggtggtactgcgacaacgccggatctgtgtccttctttccccaggctgaaacctgtaaggttcagtcaaatagagtgttctgcgatacaatgaacagtagaactctgcctagcgaggtcaatctctgcaacgtggacatctttaatccaaaatatgattgtaagataatgacctccaaaacagacgtatctagctcagttattaccagtctgggtgccatcgtgtcctgctacggcaagactaaatgtacagcaagcaacaagtgcagggggatcattaagaccttctctaatggatgtgattatgtctcaaacaaaggcgtggacactgtcagtgtgggtaatacgctttactatgttaacaagcaagaggggaaaagcctgtacgtgaagggagaacccatcattaatttttatgaccctttggtattcccatccgatgagtttgacgcttctatatcgcaggtcaacgagaaaatcaaccagagcctcgccttcattcggaagtccgatgaactgttacacaatgtgaacgcgggcaagtcaacaaccaatatcatgatcactaccattataatcgttattatcgtgattctgctaagtctcatcgccgtcggcctgcttttgtactgcaaagcacgctctacaccggtgaccctgagcaaggaccagctctccgggataaacaatatcgctttctcaaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5339 - RNA, 1887 nt, synthetic construct
  misc_feature 1..1887: note = mRNA product Design a-1 comprising derived and/or modified sequence from HRSV(A2)__F_DSCav1_mut5 (opt4)
  source 1..1887: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5340 - RNA, 1887 nt, synthetic construct
  misc_feature 1..1887: note = mRNA product Design a-1 comprising derived and/or modified sequence from HRSV(A2)__F_DSCav1_mut5 (opt5)
  source 1..1887: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcggatgcggcgtttctgtgctgacatttaaggtccttgacctgaagaactacattgataaacaactcctgcctatcctgaataagcagtcctgtagcatttctaacatcgagaccgtgattgagttccagcagaaaaataaccggctcctggaaatcacgcgcgagttttccgtgaatgccggcgtcacaaccccggttagcacatatatgcttaccaactccgaactgctctctctgatcaatgacatgcccattaccaacgatcaaaagaaacttatgagcaacaatgtgcagatcgtgagacagcagtcctacagcattatgtgcatcattaaggaggaagtcctggcttatgtggttcaactccctctgtacggggtgatcgacacaccctgttggaaactgcatacgtctcctctctgcaccacaaacaccaaggagggatccaatatctgtctgacacggaccgatcgcggctggtactgcgacaacgccgggagcgtctctttctttccccaggcggaaacgtgtaaggtgcagagcaatagagttttctgcgatacaatgaactccagaaccctgccttctgaggtgaatctctgcaacgtcgacatttttaatccgaaatatgattgtaagatcatgaccagcaaaacagacgtgtccagctctgtcattacctccctgggagccatcgtgagctgctacggcaagacaaaatgtacggcttctaacaagtgccgggggattatcaagaccttctccaatggatgtgattatgttagcaacaaaggcgtggacacagtctccgtgggcaataccctttactatgttaacaagcaagaggggaaatctctgtacgtgaagggagaacccatcattaatttttatgaccctctcgtcttccccagcgatgagtttgacgcctccatctctcaggtgaacgagaaaattaaccagagcctggctttcatccgcaagtccgatgaactgctccacaatgtgaacgccggcaagagcacaaccaatattatgatcacgaccattatcatcgttattatcgtcattctgctttctctgatcgccgtggggctcctgctgtactgcaaagctagatccacacctgtgacccttagcaaggaccagctctctggaattaacaatatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5341 - RNA, 1887 nt, synthetic construct
  misc_feature 1..1887: note = mRNA product Design a-1 comprising derived and/or modified sequence from HRSV(A2)__F_DSCav1_mut5 (opt6)
  source 1..1887: mol_type = other RNA
gggagagtcccgcagtcggcgtccagcggctctgcttgttcgtgtgtgtgtcgttgcaggccttattcaagcttaccatggaactattaatacttaaagccaacgcaataacaacaattctcactgctgtcaccttctgcttcgcctcaggccaaaacataacggaagaattttaccaatcaacatgctctgcagtatccaaaggctacctatctgctctaagaacaggttggtatacatcagtaataaccatagaactatcaaacataaaagaaaataaatgcaacggaacagacgcaaaagttaaactcataaaacaagaactagacaaatataaaaacgcagttaccgaactacaactacttatgcaatccactcccgccactggatcaggatcagcaatagcatcaggagtcgcagtatgtaaagtcttacacctcgaaggcgaagtcaataaaatcaaatccgcattactatccacaaacaaagcagtcgtatccctaagcggatgcggagtatcagtactaacatttaaagtactagacctaaaaaattacatcgataaacaactattacctatattaaacaaacaatcctgctccatttcaaatatcgaaaccgtaatagaatttcaacaaaaaaacaacagattactagaaataacaagagaattttccgtaaatgctggcgtaacaacaccagtatccacatacatgctcacaaactccgaactactatcactaataaatgacatgcccataacaaacgatcaaaaaaaactaatgtcaaataatgtacaaatagtaagacaacaaagctactccatcatgtgtataataaaagaagaagtactagcatacgtagttcaactaccactttacggcgtaatcgacaccccttgctggaaactacacacctcccctctatgcaccacaaacacaaaagaaggttccaacatatgccttaccagaacagacagaggctggtattgcgacaacgcaggatcagtttcattttttccacaagctgaaacatgcaaagtacaatcaaacagagtcttctgcgacacaatgaactcaagaactctaccctcagaagtaaacctatgtaacgtagacattttcaaccccaaatacgactgcaaaattatgacatcaaaaacagacgtttcatcatcagttatcacctcattaggagcaatagtaagctgctacggaaaaacaaaatgcaccgcctcaaataaatgcagaggaataataaaaactttctccaacggatgcgactacgtttcaaacaaaggtgtagacactgtatcagtaggaaacacactatattacgtaaataaacaagaaggaaaatcactttatgtcaaaggagaaccaataatcaatttctacgacccattagtattcccatcagacgaatttgatgcttcaatatcacaagtaaacgaaaaaataaatcaatcactcgcatttatacgaaaatcagacgaactactacacaatgtaaacgcaggcaaatcaacaacaaacataatgataacaacaataatcattgtaataatagtaatacttctatctctaatagcagtaggattactcctctactgcaaagcaagatcaacccctgtaacactatcaaaagaccaactttcaggtataaataatatagctttttccaattaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5342 - RNA, 1887 nt, synthetic construct
  misc_feature 1..1887: note = mRNA product Design a-1 comprising derived and/or modified sequence from HRSV(A2)__F_DSCav1_mut5 (opt11)
  source 1..1887: mol_type = other RNA
gggagagtcccgcagtcggcgtccagcggctctgcttgttcgtgtgtgtgtcgttgcaggccttattcaagcttaccatggagctcctaatcctcaaagccaacgcgatcactacaatcctcacagccgtcaccttctgcttcgcctccggccaaaacatcaccgaggagttctaccaatcaacctgctccgccgtatcaaaaggatacctaagcgccctacggaccggctggtacacatctgtcatcaccatcgaactatcaaacatcaaagaaaacaaatgcaacggaaccgacgcaaaagtcaaactgattaaacaagaactagacaaatacaaaaacgcagtcaccgaactgcaattactcatgcaaagcacaccggccaccggctcaggcagcgccatcgcctccggcgtcgccgtctgcaaagttctccacctcgagggcgaagtcaacaaaataaaatctgccctcctctccaccaacaaagccgtcgtctccctcagcggctgcggagtctccgtcctcaccttcaaagttctcgatctcaagaactatattgacaaacaacttctacccatactcaacaaacaaagctgcagcatatccaacatcgaaaccgtcatcgagttccaacaaaagaacaaccgcctcctcgaaataacccgcgagttcagcgttaacgccggagtcactacccctgtctccacctacatgctcaccaactccgaactcctatcactaatcaacgacatgcccataaccaacgaccagaagaaactcatgtccaacaacgtccaaattgtccgacaacaaagctactccataatgtgcataataaaagaggaagtcctcgcctacgtcgtacaactgcccctttatggcgtaatcgacacaccctgctggaaactccacacgtcacccctctgcaccaccaacacaaaagaaggctcgaacatctgcctaacacggactgaccgcggctggtactgcgacaacgccggctccgtcagcttcttcccacaagccgaaacctgcaaagtacaatccaaccgagtattctgcgacaccatgaactccagaaccctcccctcagaggtcaacctgtgcaacgtagacatcttcaaccccaaatacgactgcaaaataatgacctcaaaaacagacgtctcctcttccgtaatcaccagcctcggagccatcgtcagctgctacggcaaaaccaaatgcaccgcctcaaacaaatgccgcggcatcatcaaaacattctcaaacggctgcgactacgtctccaacaaaggcgtcgacacagtaagcgtaggcaacacactgtactacgtcaacaaacaagagggaaaatcactctacgtcaaaggagaacccataatcaacttctacgaccccctcgttttccccagcgacgagttcgacgccagcatatcccaagtcaacgagaaaattaaccaatccctagcattcatccgaaaatctgacgaactgctccacaacgtcaacgcgggaaaatcaacaaccaacataatgataaccacaatcataatagtcatcatcgtaatcctcctcagcctaatcgctgtcggcctcctcctctactgcaaagcccgttccaccccagtcacactttccaaggaccaactaagcggaataaacaacatcgcgttctcaaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5343 - RNA, 1906 nt, synthetic construct
  misc_feature 1..1906: note = mRNA product Design a-2 comprising derived and/or modified sequence from HRSV(A2)__F_DSCav1_mut5 (opt1)
  source 1..1906: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5344 - RNA, 1906 nt, synthetic construct
  misc_feature 1..1906: note = mRNA product Design a-2 comprising derived and/or modified sequence from HRSV(A2)__F_DSCav1_mut5 (opt1)
  source 1..1906: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcgggtgcggcgtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggggtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggcgtgatcgacacgccgtgctggaagctgcacaccagccccctctgcaccaccaacacgaaggaggggtccaacatctgcctgacccgcaccgaccggggctggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggggccatcgtgtcctgctacggcaagaccaagtgcaccgccagcaacaagtgccgggggatcatcaagaccttctccaacggctgcgactacgtgagcaacaagggcgtcgacacggtgagcgtggggaacaccctctactacgtcaacaagcaggagggcaagtccctgtacgtgaagggggagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccggcaagtccaccaccaacatcatgatcaccacgatcatcatcgtgatcatcgtcatcctcctgagcctgatcgccgtggggctcctgctgtactgcaaggcccggtccaccccggtgaccctgagcaaggaccagctctccggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5345 - RNA, 1906 nt, synthetic construct
  misc_feature 1..1906: note = mRNA product Design a-2 comprising derived and/or modified sequence from HRSV(A2)__F_DSCav1_mut5 (opt2)
  source 1..1906: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5346 - RNA, 1906 nt, synthetic construct
  misc_feature 1..1906: note = mRNA product Design a-2 comprising derived and/or modified sequence from HRSV(A2)__F_DSCav1_mut5 (opt3)
  source 1..1906: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcggttgcggggtgtccgtattaacttttaaggttctggaccttaagaactacattgataaacaattgctgcctatcctaaataagcagtcatgtagtattagcaacatcgagaccgtgatagagttccagcagaaaaataacaggctcctggaaattacacgggagttttctgtcaatgcgggagtgactaccccagtgtccacatatatgcttaccaactcagaactgttgagcctcatcaatgacatgccgattacgaacgatcaaaagaaactgatgagtaacaatgtccagatcgttcgccagcagtcttactccatcatgtgcattataaaggaggaagtgttagcatatgtagtgcaactgcccctctacggcgtcatcgacactccttgttggaaacttcatacaagcccactgtgcaccactaacacaaaggagggctcgaatatttgtttgacccgaacggatcgtgggtggtactgcgacaacgccggatctgtgtccttctttccccaggctgaaacctgtaaggttcagtcaaatagagtgttctgcgatacaatgaacagtagaactctgcctagcgaggtcaatctctgcaacgtggacatctttaatccaaaatatgattgtaagataatgacctccaaaacagacgtatctagctcagttattaccagtctgggtgccatcgtgtcctgctacggcaagactaaatgtacagcaagcaacaagtgcagggggatcattaagaccttctctaatggatgtgattatgtctcaaacaaaggcgtggacactgtcagtgtgggtaatacgctttactatgttaacaagcaagaggggaaaagcctgtacgtgaagggagaacccatcattaatttttatgaccctttggtattcccatccgatgagtttgacgcttctatatcgcaggtcaacgagaaaatcaaccagagcctcgccttcattcggaagtccgatgaactgttacacaatgtgaacgcgggcaagtcaacaaccaatatcatgatcactaccattataatcgttattatcgtgattctgctaagtctcatcgccgtcggcctgcttttgtactgcaaagcacgctctacaccggtgaccctgagcaaggaccagctctccgggataaacaatatcgctttctcaaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5347 - RNA, 1906 nt, synthetic construct
  misc_feature 1..1906: note = mRNA product Design a-2 comprising derived and/or modified sequence from HRSV(A2)__F_DSCav1_mut5 (opt4)
  source 1..1906: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5348 - RNA, 1906 nt, synthetic construct
  misc_feature 1..1906: note = mRNA product Design a-2 comprising derived and/or modified sequence from HRSV(A2)__F_DSCav1_mut5 (opt5)
  source 1..1906: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcggatgcggcgtttctgtgctgacatttaaggtccttgacctgaagaactacattgataaacaactcctgcctatcctgaataagcagtcctgtagcatttctaacatcgagaccgtgattgagttccagcagaaaaataaccggctcctggaaatcacgcgcgagttttccgtgaatgccggcgtcacaaccccggttagcacatatatgcttaccaactccgaactgctctctctgatcaatgacatgcccattaccaacgatcaaaagaaacttatgagcaacaatgtgcagatcgtgagacagcagtcctacagcattatgtgcatcattaaggaggaagtcctggcttatgtggttcaactccctctgtacggggtgatcgacacaccctgttggaaactgcatacgtctcctctctgcaccacaaacaccaaggagggatccaatatctgtctgacacggaccgatcgcggctggtactgcgacaacgccgggagcgtctctttctttccccaggcggaaacgtgtaaggtgcagagcaatagagttttctgcgatacaatgaactccagaaccctgccttctgaggtgaatctctgcaacgtcgacatttttaatccgaaatatgattgtaagatcatgaccagcaaaacagacgtgtccagctctgtcattacctccctgggagccatcgtgagctgctacggcaagacaaaatgtacggcttctaacaagtgccgggggattatcaagaccttctccaatggatgtgattatgttagcaacaaaggcgtggacacagtctccgtgggcaataccctttactatgttaacaagcaagaggggaaatctctgtacgtgaagggagaacccatcattaatttttatgaccctctcgtcttccccagcgatgagtttgacgcctccatctctcaggtgaacgagaaaattaaccagagcctggctttcatccgcaagtccgatgaactgctccacaatgtgaacgccggcaagagcacaaccaatattatgatcacgaccattatcatcgttattatcgtcattctgctttctctgatcgccgtggggctcctgctgtactgcaaagctagatccacacctgtgacccttagcaaggaccagctctctggaattaacaatatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5349 - RNA, 1906 nt, synthetic construct
  misc_feature 1..1906: note = mRNA product Design a-2 comprising derived and/or modified sequence from HRSV(A2)__F_DSCav1_mut5 (opt6)
  source 1..1906: mol_type = other RNA
gggagagtccgctcagccaggttgcagaagcggcttagcgtgtgtcctaatcttctctctgcgtgtaggtaggcctgtgccgcaaacaagcttaccatggaactattaatacttaaagccaacgcaataacaacaattctcactgctgtcaccttctgcttcgcctcaggccaaaacataacggaagaattttaccaatcaacatgctctgcagtatccaaaggctacctatctgctctaagaacaggttggtatacatcagtaataaccatagaactatcaaacataaaagaaaataaatgcaacggaacagacgcaaaagttaaactcataaaacaagaactagacaaatataaaaacgcagttaccgaactacaactacttatgcaatccactcccgccactggatcaggatcagcaatagcatcaggagtcgcagtatgtaaagtcttacacctcgaaggcgaagtcaataaaatcaaatccgcattactatccacaaacaaagcagtcgtatccctaagcggatgcggagtatcagtactaacatttaaagtactagacctaaaaaattacatcgataaacaactattacctatattaaacaaacaatcctgctccatttcaaatatcgaaaccgtaatagaatttcaacaaaaaaacaacagattactagaaataacaagagaattttccgtaaatgctggcgtaacaacaccagtatccacatacatgctcacaaactccgaactactatcactaataaatgacatgcccataacaaacgatcaaaaaaaactaatgtcaaataatgtacaaatagtaagacaacaaagctactccatcatgtgtataataaaagaagaagtactagcatacgtagttcaactaccactttacggcgtaatcgacaccccttgctggaaactacacacctcccctctatgcaccacaaacacaaaagaaggttccaacatatgccttaccagaacagacagaggctggtattgcgacaacgcaggatcagtttcattttttccacaagctgaaacatgcaaagtacaatcaaacagagtcttctgcgacacaatgaactcaagaactctaccctcagaagtaaacctatgtaacgtagacattttcaaccccaaatacgactgcaaaattatgacatcaaaaacagacgtttcatcatcagttatcacctcattaggagcaatagtaagctgctacggaaaaacaaaatgcaccgcctcaaataaatgcagaggaataataaaaactttctccaacggatgcgactacgtttcaaacaaaggtgtagacactgtatcagtaggaaacacactatattacgtaaataaacaagaaggaaaatcactttatgtcaaaggagaaccaataatcaatttctacgacccattagtattcccatcagacgaatttgatgcttcaatatcacaagtaaacgaaaaaataaatcaatcactcgcatttatacgaaaatcagacgaactactacacaatgtaaacgcaggcaaatcaacaacaaacataatgataacaacaataatcattgtaataatagtaatacttctatctctaatagcagtaggattactcctctactgcaaagcaagatcaacccctgtaacactatcaaaagaccaactttcaggtataaataatatagctttttccaattaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5350 - RNA, 1906 nt, synthetic construct
  misc_feature 1..1906: note = mRNA product Design a-2 comprising derived and/or modified sequence from HRSV(A2)__F_DSCav1_mut5 (opt11)
  source 1..1906: mol_type = other RNA
gggagagtccgctcagccaggttgcagaagcggcttagcgtgtgtcctaatcttctctctgcgtgtaggtaggcctgtgccgcaaacaagcttaccatggagctcctaatcctcaaagccaacgcgatcactacaatcctcacagccgtcaccttctgcttcgcctccggccaaaacatcaccgaggagttctaccaatcaacctgctccgccgtatcaaaaggatacctaagcgccctacggaccggctggtacacatctgtcatcaccatcgaactatcaaacatcaaagaaaacaaatgcaacggaaccgacgcaaaagtcaaactgattaaacaagaactagacaaatacaaaaacgcagtcaccgaactgcaattactcatgcaaagcacaccggccaccggctcaggcagcgccatcgcctccggcgtcgccgtctgcaaagttctccacctcgagggcgaagtcaacaaaataaaatctgccctcctctccaccaacaaagccgtcgtctccctcagcggctgcggagtctccgtcctcaccttcaaagttctcgatctcaagaactatattgacaaacaacttctacccatactcaacaaacaaagctgcagcatatccaacatcgaaaccgtcatcgagttccaacaaaagaacaaccgcctcctcgaaataacccgcgagttcagcgttaacgccggagtcactacccctgtctccacctacatgctcaccaactccgaactcctatcactaatcaacgacatgcccataaccaacgaccagaagaaactcatgtccaacaacgtccaaattgtccgacaacaaagctactccataatgtgcataataaaagaggaagtcctcgcctacgtcgtacaactgcccctttatggcgtaatcgacacaccctgctggaaactccacacgtcacccctctgcaccaccaacacaaaagaaggctcgaacatctgcctaacacggactgaccgcggctggtactgcgacaacgccggctccgtcagcttcttcccacaagccgaaacctgcaaagtacaatccaaccgagtattctgcgacaccatgaactccagaaccctcccctcagaggtcaacctgtgcaacgtagacatcttcaaccccaaatacgactgcaaaataatgacctcaaaaacagacgtctcctcttccgtaatcaccagcctcggagccatcgtcagctgctacggcaaaaccaaatgcaccgcctcaaacaaatgccgcggcatcatcaaaacattctcaaacggctgcgactacgtctccaacaaaggcgtcgacacagtaagcgtaggcaacacactgtactacgtcaacaaacaagagggaaaatcactctacgtcaaaggagaacccataatcaacttctacgaccccctcgttttccccagcgacgagttcgacgccagcatatcccaagtcaacgagaaaattaaccaatccctagcattcatccgaaaatctgacgaactgctccacaacgtcaacgcgggaaaatcaacaaccaacataatgataaccacaatcataatagtcatcatcgtaatcctcctcagcctaatcgctgtcggcctcctcctctactgcaaagcccgttccaccccagtcacactttccaaggaccaactaagcggaataaacaacatcgcgttctcaaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5351 - RNA, 1984 nt, synthetic construct
  misc_feature 1..1984: note = mRNA product Design a-3 comprising derived and/or modified sequence from HRSV(A2)__F_DSCav1_mut5 (opt1)
  source 1..1984: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5352 - RNA, 1984 nt, synthetic construct
  misc_feature 1..1984: note = mRNA product Design a-3 comprising derived and/or modified sequence from HRSV(A2)__F_DSCav1_mut5 (opt1)
  source 1..1984: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcgggtgcggcgtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggggtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggcgtgatcgacacgccgtgctggaagctgcacaccagccccctctgcaccaccaacacgaaggaggggtccaacatctgcctgacccgcaccgaccggggctggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggggccatcgtgtcctgctacggcaagaccaagtgcaccgccagcaacaagtgccgggggatcatcaagaccttctccaacggctgcgactacgtgagcaacaagggcgtcgacacggtgagcgtggggaacaccctctactacgtcaacaagcaggagggcaagtccctgtacgtgaagggggagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccggcaagtccaccaccaacatcatgatcaccacgatcatcatcgtgatcatcgtcatcctcctgagcctgatcgccgtggggctcctgctgtactgcaaggcccggtccaccccggtgaccctgagcaaggaccagctctccggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5353 - RNA, 1984 nt, synthetic construct
  misc_feature 1..1984: note = mRNA product Design a-3 comprising derived and/or modified sequence from HRSV(A2)__F_DSCav1_mut5 (opt2)
  source 1..1984: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5354 - RNA, 1984 nt, synthetic construct
  misc_feature 1..1984: note = mRNA product Design a-3 comprising derived and/or modified sequence from HRSV(A2)__F_DSCav1_mut5 (opt3)
  source 1..1984: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcggttgcggggtgtccgtattaacttttaaggttctggaccttaagaactacattgataaacaattgctgcctatcctaaataagcagtcatgtagtattagcaacatcgagaccgtgatagagttccagcagaaaaataacaggctcctggaaattacacgggagttttctgtcaatgcgggagtgactaccccagtgtccacatatatgcttaccaactcagaactgttgagcctcatcaatgacatgccgattacgaacgatcaaaagaaactgatgagtaacaatgtccagatcgttcgccagcagtcttactccatcatgtgcattataaaggaggaagtgttagcatatgtagtgcaactgcccctctacggcgtcatcgacactccttgttggaaacttcatacaagcccactgtgcaccactaacacaaaggagggctcgaatatttgtttgacccgaacggatcgtgggtggtactgcgacaacgccggatctgtgtccttctttccccaggctgaaacctgtaaggttcagtcaaatagagtgttctgcgatacaatgaacagtagaactctgcctagcgaggtcaatctctgcaacgtggacatctttaatccaaaatatgattgtaagataatgacctccaaaacagacgtatctagctcagttattaccagtctgggtgccatcgtgtcctgctacggcaagactaaatgtacagcaagcaacaagtgcagggggatcattaagaccttctctaatggatgtgattatgtctcaaacaaaggcgtggacactgtcagtgtgggtaatacgctttactatgttaacaagcaagaggggaaaagcctgtacgtgaagggagaacccatcattaatttttatgaccctttggtattcccatccgatgagtttgacgcttctatatcgcaggtcaacgagaaaatcaaccagagcctcgccttcattcggaagtccgatgaactgttacacaatgtgaacgcgggcaagtcaacaaccaatatcatgatcactaccattataatcgttattatcgtgattctgctaagtctcatcgccgtcggcctgcttttgtactgcaaagcacgctctacaccggtgaccctgagcaaggaccagctctccgggataaacaatatcgctttctcaaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5355 - RNA, 1984 nt, synthetic construct
  misc_feature 1..1984: note = mRNA product Design a-3 comprising derived and/or modified sequence from HRSV(A2)__F_DSCav1_mut5 (opt4)
  source 1..1984: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5356 - RNA, 1984 nt, synthetic construct
  misc_feature 1..1984: note = mRNA product Design a-3 comprising derived and/or modified sequence from HRSV(A2)__F_DSCav1_mut5 (opt5)
  source 1..1984: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcggatgcggcgtttctgtgctgacatttaaggtccttgacctgaagaactacattgataaacaactcctgcctatcctgaataagcagtcctgtagcatttctaacatcgagaccgtgattgagttccagcagaaaaataaccggctcctggaaatcacgcgcgagttttccgtgaatgccggcgtcacaaccccggttagcacatatatgcttaccaactccgaactgctctctctgatcaatgacatgcccattaccaacgatcaaaagaaacttatgagcaacaatgtgcagatcgtgagacagcagtcctacagcattatgtgcatcattaaggaggaagtcctggcttatgtggttcaactccctctgtacggggtgatcgacacaccctgttggaaactgcatacgtctcctctctgcaccacaaacaccaaggagggatccaatatctgtctgacacggaccgatcgcggctggtactgcgacaacgccgggagcgtctctttctttccccaggcggaaacgtgtaaggtgcagagcaatagagttttctgcgatacaatgaactccagaaccctgccttctgaggtgaatctctgcaacgtcgacatttttaatccgaaatatgattgtaagatcatgaccagcaaaacagacgtgtccagctctgtcattacctccctgggagccatcgtgagctgctacggcaagacaaaatgtacggcttctaacaagtgccgggggattatcaagaccttctccaatggatgtgattatgttagcaacaaaggcgtggacacagtctccgtgggcaataccctttactatgttaacaagcaagaggggaaatctctgtacgtgaagggagaacccatcattaatttttatgaccctctcgtcttccccagcgatgagtttgacgcctccatctctcaggtgaacgagaaaattaaccagagcctggctttcatccgcaagtccgatgaactgctccacaatgtgaacgccggcaagagcacaaccaatattatgatcacgaccattatcatcgttattatcgtcattctgctttctctgatcgccgtggggctcctgctgtactgcaaagctagatccacacctgtgacccttagcaaggaccagctctctggaattaacaatatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5357 - RNA, 1984 nt, synthetic construct
  misc_feature 1..1984: note = mRNA product Design a-3 comprising derived and/or modified sequence from HRSV(A2)__F_DSCav1_mut5 (opt6)
  source 1..1984: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactattaatacttaaagccaacgcaataacaacaattctcactgctgtcaccttctgcttcgcctcaggccaaaacataacggaagaattttaccaatcaacatgctctgcagtatccaaaggctacctatctgctctaagaacaggttggtatacatcagtaataaccatagaactatcaaacataaaagaaaataaatgcaacggaacagacgcaaaagttaaactcataaaacaagaactagacaaatataaaaacgcagttaccgaactacaactacttatgcaatccactcccgccactggatcaggatcagcaatagcatcaggagtcgcagtatgtaaagtcttacacctcgaaggcgaagtcaataaaatcaaatccgcattactatccacaaacaaagcagtcgtatccctaagcggatgcggagtatcagtactaacatttaaagtactagacctaaaaaattacatcgataaacaactattacctatattaaacaaacaatcctgctccatttcaaatatcgaaaccgtaatagaatttcaacaaaaaaacaacagattactagaaataacaagagaattttccgtaaatgctggcgtaacaacaccagtatccacatacatgctcacaaactccgaactactatcactaataaatgacatgcccataacaaacgatcaaaaaaaactaatgtcaaataatgtacaaatagtaagacaacaaagctactccatcatgtgtataataaaagaagaagtactagcatacgtagttcaactaccactttacggcgtaatcgacaccccttgctggaaactacacacctcccctctatgcaccacaaacacaaaagaaggttccaacatatgccttaccagaacagacagaggctggtattgcgacaacgcaggatcagtttcattttttccacaagctgaaacatgcaaagtacaatcaaacagagtcttctgcgacacaatgaactcaagaactctaccctcagaagtaaacctatgtaacgtagacattttcaaccccaaatacgactgcaaaattatgacatcaaaaacagacgtttcatcatcagttatcacctcattaggagcaatagtaagctgctacggaaaaacaaaatgcaccgcctcaaataaatgcagaggaataataaaaactttctccaacggatgcgactacgtttcaaacaaaggtgtagacactgtatcagtaggaaacacactatattacgtaaataaacaagaaggaaaatcactttatgtcaaaggagaaccaataatcaatttctacgacccattagtattcccatcagacgaatttgatgcttcaatatcacaagtaaacgaaaaaataaatcaatcactcgcatttatacgaaaatcagacgaactactacacaatgtaaacgcaggcaaatcaacaacaaacataatgataacaacaataatcattgtaataatagtaatacttctatctctaatagcagtaggattactcctctactgcaaagcaagatcaacccctgtaacactatcaaaagaccaactttcaggtataaataatatagctttttccaattaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5358 - RNA, 1984 nt, synthetic construct
  misc_feature 1..1984: note = mRNA product Design a-3 comprising derived and/or modified sequence from HRSV(A2)__F_DSCav1_mut5 (opt11)
  source 1..1984: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctaatcctcaaagccaacgcgatcactacaatcctcacagccgtcaccttctgcttcgcctccggccaaaacatcaccgaggagttctaccaatcaacctgctccgccgtatcaaaaggatacctaagcgccctacggaccggctggtacacatctgtcatcaccatcgaactatcaaacatcaaagaaaacaaatgcaacggaaccgacgcaaaagtcaaactgattaaacaagaactagacaaatacaaaaacgcagtcaccgaactgcaattactcatgcaaagcacaccggccaccggctcaggcagcgccatcgcctccggcgtcgccgtctgcaaagttctccacctcgagggcgaagtcaacaaaataaaatctgccctcctctccaccaacaaagccgtcgtctccctcagcggctgcggagtctccgtcctcaccttcaaagttctcgatctcaagaactatattgacaaacaacttctacccatactcaacaaacaaagctgcagcatatccaacatcgaaaccgtcatcgagttccaacaaaagaacaaccgcctcctcgaaataacccgcgagttcagcgttaacgccggagtcactacccctgtctccacctacatgctcaccaactccgaactcctatcactaatcaacgacatgcccataaccaacgaccagaagaaactcatgtccaacaacgtccaaattgtccgacaacaaagctactccataatgtgcataataaaagaggaagtcctcgcctacgtcgtacaactgcccctttatggcgtaatcgacacaccctgctggaaactccacacgtcacccctctgcaccaccaacacaaaagaaggctcgaacatctgcctaacacggactgaccgcggctggtactgcgacaacgccggctccgtcagcttcttcccacaagccgaaacctgcaaagtacaatccaaccgagtattctgcgacaccatgaactccagaaccctcccctcagaggtcaacctgtgcaacgtagacatcttcaaccccaaatacgactgcaaaataatgacctcaaaaacagacgtctcctcttccgtaatcaccagcctcggagccatcgtcagctgctacggcaaaaccaaatgcaccgcctcaaacaaatgccgcggcatcatcaaaacattctcaaacggctgcgactacgtctccaacaaaggcgtcgacacagtaagcgtaggcaacacactgtactacgtcaacaaacaagagggaaaatcactctacgtcaaaggagaacccataatcaacttctacgaccccctcgttttccccagcgacgagttcgacgccagcatatcccaagtcaacgagaaaattaaccaatccctagcattcatccgaaaatctgacgaactgctccacaacgtcaacgcgggaaaatcaacaaccaacataatgataaccacaatcataatagtcatcatcgtaatcctcctcagcctaatcgctgtcggcctcctcctctactgcaaagcccgttccaccccagtcacactttccaaggaccaactaagcggaataaacaacatcgcgttctcaaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5359 - RNA, 1933 nt, synthetic construct
  misc_feature 1..1933: note = mRNA product Design a-4 comprising derived and/or modified sequence from HRSV(A2)__F_DSCav1_mut5 (opt1)
  source 1..1933: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5360 - RNA, 1933 nt, synthetic construct
  misc_feature 1..1933: note = mRNA product Design a-4 comprising derived and/or modified sequence from HRSV(A2)__F_DSCav1_mut5 (opt1)
  source 1..1933: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcgggtgcggcgtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggggtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggcgtgatcgacacgccgtgctggaagctgcacaccagccccctctgcaccaccaacacgaaggaggggtccaacatctgcctgacccgcaccgaccggggctggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggggccatcgtgtcctgctacggcaagaccaagtgcaccgccagcaacaagtgccgggggatcatcaagaccttctccaacggctgcgactacgtgagcaacaagggcgtcgacacggtgagcgtggggaacaccctctactacgtcaacaagcaggagggcaagtccctgtacgtgaagggggagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccggcaagtccaccaccaacatcatgatcaccacgatcatcatcgtgatcatcgtcatcctcctgagcctgatcgccgtggggctcctgctgtactgcaaggcccggtccaccccggtgaccctgagcaaggaccagctctccggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5361 - RNA, 1933 nt, synthetic construct
  misc_feature 1..1933: note = mRNA product Design a-4 comprising derived and/or modified sequence from HRSV(A2)__F_DSCav1_mut5 (opt2)
  source 1..1933: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5362 - RNA, 1933 nt, synthetic construct
  misc_feature 1..1933: note = mRNA product Design a-4 comprising derived and/or modified sequence from HRSV(A2)__F_DSCav1_mut5 (opt3)
  source 1..1933: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcggttgcggggtgtccgtattaacttttaaggttctggaccttaagaactacattgataaacaattgctgcctatcctaaataagcagtcatgtagtattagcaacatcgagaccgtgatagagttccagcagaaaaataacaggctcctggaaattacacgggagttttctgtcaatgcgggagtgactaccccagtgtccacatatatgcttaccaactcagaactgttgagcctcatcaatgacatgccgattacgaacgatcaaaagaaactgatgagtaacaatgtccagatcgttcgccagcagtcttactccatcatgtgcattataaaggaggaagtgttagcatatgtagtgcaactgcccctctacggcgtcatcgacactccttgttggaaacttcatacaagcccactgtgcaccactaacacaaaggagggctcgaatatttgtttgacccgaacggatcgtgggtggtactgcgacaacgccggatctgtgtccttctttccccaggctgaaacctgtaaggttcagtcaaatagagtgttctgcgatacaatgaacagtagaactctgcctagcgaggtcaatctctgcaacgtggacatctttaatccaaaatatgattgtaagataatgacctccaaaacagacgtatctagctcagttattaccagtctgggtgccatcgtgtcctgctacggcaagactaaatgtacagcaagcaacaagtgcagggggatcattaagaccttctctaatggatgtgattatgtctcaaacaaaggcgtggacactgtcagtgtgggtaatacgctttactatgttaacaagcaagaggggaaaagcctgtacgtgaagggagaacccatcattaatttttatgaccctttggtattcccatccgatgagtttgacgcttctatatcgcaggtcaacgagaaaatcaaccagagcctcgccttcattcggaagtccgatgaactgttacacaatgtgaacgcgggcaagtcaacaaccaatatcatgatcactaccattataatcgttattatcgtgattctgctaagtctcatcgccgtcggcctgcttttgtactgcaaagcacgctctacaccggtgaccctgagcaaggaccagctctccgggataaacaatatcgctttctcaaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5363 - RNA, 1933 nt, synthetic construct
  misc_feature 1..1933: note = mRNA product Design a-4 comprising derived and/or modified sequence from HRSV(A2)__F_DSCav1_mut5 (opt4)
  source 1..1933: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5364 - RNA, 1933 nt, synthetic construct
  misc_feature 1..1933: note = mRNA product Design a-4 comprising derived and/or modified sequence from HRSV(A2)__F_DSCav1_mut5 (opt5)
  source 1..1933: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcggatgcggcgtttctgtgctgacatttaaggtccttgacctgaagaactacattgataaacaactcctgcctatcctgaataagcagtcctgtagcatttctaacatcgagaccgtgattgagttccagcagaaaaataaccggctcctggaaatcacgcgcgagttttccgtgaatgccggcgtcacaaccccggttagcacatatatgcttaccaactccgaactgctctctctgatcaatgacatgcccattaccaacgatcaaaagaaacttatgagcaacaatgtgcagatcgtgagacagcagtcctacagcattatgtgcatcattaaggaggaagtcctggcttatgtggttcaactccctctgtacggggtgatcgacacaccctgttggaaactgcatacgtctcctctctgcaccacaaacaccaaggagggatccaatatctgtctgacacggaccgatcgcggctggtactgcgacaacgccgggagcgtctctttctttccccaggcggaaacgtgtaaggtgcagagcaatagagttttctgcgatacaatgaactccagaaccctgccttctgaggtgaatctctgcaacgtcgacatttttaatccgaaatatgattgtaagatcatgaccagcaaaacagacgtgtccagctctgtcattacctccctgggagccatcgtgagctgctacggcaagacaaaatgtacggcttctaacaagtgccgggggattatcaagaccttctccaatggatgtgattatgttagcaacaaaggcgtggacacagtctccgtgggcaataccctttactatgttaacaagcaagaggggaaatctctgtacgtgaagggagaacccatcattaatttttatgaccctctcgtcttccccagcgatgagtttgacgcctccatctctcaggtgaacgagaaaattaaccagagcctggctttcatccgcaagtccgatgaactgctccacaatgtgaacgccggcaagagcacaaccaatattatgatcacgaccattatcatcgttattatcgtcattctgctttctctgatcgccgtggggctcctgctgtactgcaaagctagatccacacctgtgacccttagcaaggaccagctctctggaattaacaatatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5365 - RNA, 1933 nt, synthetic construct
  misc_feature 1..1933: note = mRNA product Design a-4 comprising derived and/or modified sequence from HRSV(A2)__F_DSCav1_mut5 (opt6)
  source 1..1933: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactattaatacttaaagccaacgcaataacaacaattctcactgctgtcaccttctgcttcgcctcaggccaaaacataacggaagaattttaccaatcaacatgctctgcagtatccaaaggctacctatctgctctaagaacaggttggtatacatcagtaataaccatagaactatcaaacataaaagaaaataaatgcaacggaacagacgcaaaagttaaactcataaaacaagaactagacaaatataaaaacgcagttaccgaactacaactacttatgcaatccactcccgccactggatcaggatcagcaatagcatcaggagtcgcagtatgtaaagtcttacacctcgaaggcgaagtcaataaaatcaaatccgcattactatccacaaacaaagcagtcgtatccctaagcggatgcggagtatcagtactaacatttaaagtactagacctaaaaaattacatcgataaacaactattacctatattaaacaaacaatcctgctccatttcaaatatcgaaaccgtaatagaatttcaacaaaaaaacaacagattactagaaataacaagagaattttccgtaaatgctggcgtaacaacaccagtatccacatacatgctcacaaactccgaactactatcactaataaatgacatgcccataacaaacgatcaaaaaaaactaatgtcaaataatgtacaaatagtaagacaacaaagctactccatcatgtgtataataaaagaagaagtactagcatacgtagttcaactaccactttacggcgtaatcgacaccccttgctggaaactacacacctcccctctatgcaccacaaacacaaaagaaggttccaacatatgccttaccagaacagacagaggctggtattgcgacaacgcaggatcagtttcattttttccacaagctgaaacatgcaaagtacaatcaaacagagtcttctgcgacacaatgaactcaagaactctaccctcagaagtaaacctatgtaacgtagacattttcaaccccaaatacgactgcaaaattatgacatcaaaaacagacgtttcatcatcagttatcacctcattaggagcaatagtaagctgctacggaaaaacaaaatgcaccgcctcaaataaatgcagaggaataataaaaactttctccaacggatgcgactacgtttcaaacaaaggtgtagacactgtatcagtaggaaacacactatattacgtaaataaacaagaaggaaaatcactttatgtcaaaggagaaccaataatcaatttctacgacccattagtattcccatcagacgaatttgatgcttcaatatcacaagtaaacgaaaaaataaatcaatcactcgcatttatacgaaaatcagacgaactactacacaatgtaaacgcaggcaaatcaacaacaaacataatgataacaacaataatcattgtaataatagtaatacttctatctctaatagcagtaggattactcctctactgcaaagcaagatcaacccctgtaacactatcaaaagaccaactttcaggtataaataatatagctttttccaattaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5366 - RNA, 1933 nt, synthetic construct
  misc_feature 1..1933: note = mRNA product Design a-4 comprising derived and/or modified sequence from HRSV(A2)__F_DSCav1_mut5 (opt11)
  source 1..1933: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctaatcctcaaagccaacgcgatcactacaatcctcacagccgtcaccttctgcttcgcctccggccaaaacatcaccgaggagttctaccaatcaacctgctccgccgtatcaaaaggatacctaagcgccctacggaccggctggtacacatctgtcatcaccatcgaactatcaaacatcaaagaaaacaaatgcaacggaaccgacgcaaaagtcaaactgattaaacaagaactagacaaatacaaaaacgcagtcaccgaactgcaattactcatgcaaagcacaccggccaccggctcaggcagcgccatcgcctccggcgtcgccgtctgcaaagttctccacctcgagggcgaagtcaacaaaataaaatctgccctcctctccaccaacaaagccgtcgtctccctcagcggctgcggagtctccgtcctcaccttcaaagttctcgatctcaagaactatattgacaaacaacttctacccatactcaacaaacaaagctgcagcatatccaacatcgaaaccgtcatcgagttccaacaaaagaacaaccgcctcctcgaaataacccgcgagttcagcgttaacgccggagtcactacccctgtctccacctacatgctcaccaactccgaactcctatcactaatcaacgacatgcccataaccaacgaccagaagaaactcatgtccaacaacgtccaaattgtccgacaacaaagctactccataatgtgcataataaaagaggaagtcctcgcctacgtcgtacaactgcccctttatggcgtaatcgacacaccctgctggaaactccacacgtcacccctctgcaccaccaacacaaaagaaggctcgaacatctgcctaacacggactgaccgcggctggtactgcgacaacgccggctccgtcagcttcttcccacaagccgaaacctgcaaagtacaatccaaccgagtattctgcgacaccatgaactccagaaccctcccctcagaggtcaacctgtgcaacgtagacatcttcaaccccaaatacgactgcaaaataatgacctcaaaaacagacgtctcctcttccgtaatcaccagcctcggagccatcgtcagctgctacggcaaaaccaaatgcaccgcctcaaacaaatgccgcggcatcatcaaaacattctcaaacggctgcgactacgtctccaacaaaggcgtcgacacagtaagcgtaggcaacacactgtactacgtcaacaaacaagagggaaaatcactctacgtcaaaggagaacccataatcaacttctacgaccccctcgttttccccagcgacgagttcgacgccagcatatcccaagtcaacgagaaaattaaccaatccctagcattcatccgaaaatctgacgaactgctccacaacgtcaacgcgggaaaatcaacaaccaacataatgataaccacaatcataatagtcatcatcgtaatcctcctcagcctaatcgctgtcggcctcctcctctactgcaaagcccgttccaccccagtcacactttccaaggaccaactaagcggaataaacaacatcgcgttctcaaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5367 - RNA, 1879 nt, synthetic construct
  misc_feature 1..1879: note = mRNA product Design a-5 comprising derived and/or modified sequence from HRSV(A2)__F_DSCav1_mut5 (opt1)
  source 1..1879: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5368 - RNA, 1879 nt, synthetic construct
  misc_feature 1..1879: note = mRNA product Design a-5 comprising derived and/or modified sequence from HRSV(A2)__F_DSCav1_mut5 (opt1)
  source 1..1879: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcgggtgcggcgtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggggtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggcgtgatcgacacgccgtgctggaagctgcacaccagccccctctgcaccaccaacacgaaggaggggtccaacatctgcctgacccgcaccgaccggggctggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggggccatcgtgtcctgctacggcaagaccaagtgcaccgccagcaacaagtgccgggggatcatcaagaccttctccaacggctgcgactacgtgagcaacaagggcgtcgacacggtgagcgtggggaacaccctctactacgtcaacaagcaggagggcaagtccctgtacgtgaagggggagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccggcaagtccaccaccaacatcatgatcaccacgatcatcatcgtgatcatcgtcatcctcctgagcctgatcgccgtggggctcctgctgtactgcaaggcccggtccaccccggtgaccctgagcaaggaccagctctccggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5369 - RNA, 1879 nt, synthetic construct
  misc_feature 1..1879: note = mRNA product Design a-5 comprising derived and/or modified sequence from HRSV(A2)__F_DSCav1_mut5 (opt2)
  source 1..1879: mol_type = other RNA
gggagactttcccattctgtagcagaatttggtgttgcctgtggtcttggtcccgcggagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5370 - RNA, 1879 nt, synthetic construct
  misc_feature 1..1879: note = mRNA product Design a-5 comprising derived and/or modified sequence from HRSV(A2)__F_DSCav1_mut5 (opt3)
  source 1..1879: mol_type = other RNA
gggagactttcccattctgtagcagaatttggtgttgcctgtggtcttggtcccgcggagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcggttgcggggtgtccgtattaacttttaaggttctggaccttaagaactacattgataaacaattgctgcctatcctaaataagcagtcatgtagtattagcaacatcgagaccgtgatagagttccagcagaaaaataacaggctcctggaaattacacgggagttttctgtcaatgcgggagtgactaccccagtgtccacatatatgcttaccaactcagaactgttgagcctcatcaatgacatgccgattacgaacgatcaaaagaaactgatgagtaacaatgtccagatcgttcgccagcagtcttactccatcatgtgcattataaaggaggaagtgttagcatatgtagtgcaactgcccctctacggcgtcatcgacactccttgttggaaacttcatacaagcccactgtgcaccactaacacaaaggagggctcgaatatttgtttgacccgaacggatcgtgggtggtactgcgacaacgccggatctgtgtccttctttccccaggctgaaacctgtaaggttcagtcaaatagagtgttctgcgatacaatgaacagtagaactctgcctagcgaggtcaatctctgcaacgtggacatctttaatccaaaatatgattgtaagataatgacctccaaaacagacgtatctagctcagttattaccagtctgggtgccatcgtgtcctgctacggcaagactaaatgtacagcaagcaacaagtgcagggggatcattaagaccttctctaatggatgtgattatgtctcaaacaaaggcgtggacactgtcagtgtgggtaatacgctttactatgttaacaagcaagaggggaaaagcctgtacgtgaagggagaacccatcattaatttttatgaccctttggtattcccatccgatgagtttgacgcttctatatcgcaggtcaacgagaaaatcaaccagagcctcgccttcattcggaagtccgatgaactgttacacaatgtgaacgcgggcaagtcaacaaccaatatcatgatcactaccattataatcgttattatcgtgattctgctaagtctcatcgccgtcggcctgcttttgtactgcaaagcacgctctacaccggtgaccctgagcaaggaccagctctccgggataaacaatatcgctttctcaaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5371 - RNA, 1879 nt, synthetic construct
  misc_feature 1..1879: note = mRNA product Design a-5 comprising derived and/or modified sequence from HRSV(A2)__F_DSCav1_mut5 (opt4)
  source 1..1879: mol_type = other RNA
gggagactttcccattctgtagcagaatttggtgttgcctgtggtcttggtcccgcggagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5372 - RNA, 1879 nt, synthetic construct
  misc_feature 1..1879: note = mRNA product Design a-5 comprising derived and/or modified sequence from HRSV(A2)__F_DSCav1_mut5 (opt5)
  source 1..1879: mol_type = other RNA
gggagactttcccattctgtagcagaatttggtgttgcctgtggtcttggtcccgcggagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcggatgcggcgtttctgtgctgacatttaaggtccttgacctgaagaactacattgataaacaactcctgcctatcctgaataagcagtcctgtagcatttctaacatcgagaccgtgattgagttccagcagaaaaataaccggctcctggaaatcacgcgcgagttttccgtgaatgccggcgtcacaaccccggttagcacatatatgcttaccaactccgaactgctctctctgatcaatgacatgcccattaccaacgatcaaaagaaacttatgagcaacaatgtgcagatcgtgagacagcagtcctacagcattatgtgcatcattaaggaggaagtcctggcttatgtggttcaactccctctgtacggggtgatcgacacaccctgttggaaactgcatacgtctcctctctgcaccacaaacaccaaggagggatccaatatctgtctgacacggaccgatcgcggctggtactgcgacaacgccgggagcgtctctttctttccccaggcggaaacgtgtaaggtgcagagcaatagagttttctgcgatacaatgaactccagaaccctgccttctgaggtgaatctctgcaacgtcgacatttttaatccgaaatatgattgtaagatcatgaccagcaaaacagacgtgtccagctctgtcattacctccctgggagccatcgtgagctgctacggcaagacaaaatgtacggcttctaacaagtgccgggggattatcaagaccttctccaatggatgtgattatgttagcaacaaaggcgtggacacagtctccgtgggcaataccctttactatgttaacaagcaagaggggaaatctctgtacgtgaagggagaacccatcattaatttttatgaccctctcgtcttccccagcgatgagtttgacgcctccatctctcaggtgaacgagaaaattaaccagagcctggctttcatccgcaagtccgatgaactgctccacaatgtgaacgccggcaagagcacaaccaatattatgatcacgaccattatcatcgttattatcgtcattctgctttctctgatcgccgtggggctcctgctgtactgcaaagctagatccacacctgtgacccttagcaaggaccagctctctggaattaacaatatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5373 - RNA, 1879 nt, synthetic construct
  misc_feature 1..1879: note = mRNA product Design a-5 comprising derived and/or modified sequence from HRSV(A2)__F_DSCav1_mut5 (opt6)
  source 1..1879: mol_type = other RNA
gggagactttcccattctgtagcagaatttggtgttgcctgtggtcttggtcccgcggagaagcttaccatggaactattaatacttaaagccaacgcaataacaacaattctcactgctgtcaccttctgcttcgcctcaggccaaaacataacggaagaattttaccaatcaacatgctctgcagtatccaaaggctacctatctgctctaagaacaggttggtatacatcagtaataaccatagaactatcaaacataaaagaaaataaatgcaacggaacagacgcaaaagttaaactcataaaacaagaactagacaaatataaaaacgcagttaccgaactacaactacttatgcaatccactcccgccactggatcaggatcagcaatagcatcaggagtcgcagtatgtaaagtcttacacctcgaaggcgaagtcaataaaatcaaatccgcattactatccacaaacaaagcagtcgtatccctaagcggatgcggagtatcagtactaacatttaaagtactagacctaaaaaattacatcgataaacaactattacctatattaaacaaacaatcctgctccatttcaaatatcgaaaccgtaatagaatttcaacaaaaaaacaacagattactagaaataacaagagaattttccgtaaatgctggcgtaacaacaccagtatccacatacatgctcacaaactccgaactactatcactaataaatgacatgcccataacaaacgatcaaaaaaaactaatgtcaaataatgtacaaatagtaagacaacaaagctactccatcatgtgtataataaaagaagaagtactagcatacgtagttcaactaccactttacggcgtaatcgacaccccttgctggaaactacacacctcccctctatgcaccacaaacacaaaagaaggttccaacatatgccttaccagaacagacagaggctggtattgcgacaacgcaggatcagtttcattttttccacaagctgaaacatgcaaagtacaatcaaacagagtcttctgcgacacaatgaactcaagaactctaccctcagaagtaaacctatgtaacgtagacattttcaaccccaaatacgactgcaaaattatgacatcaaaaacagacgtttcatcatcagttatcacctcattaggagcaatagtaagctgctacggaaaaacaaaatgcaccgcctcaaataaatgcagaggaataataaaaactttctccaacggatgcgactacgtttcaaacaaaggtgtagacactgtatcagtaggaaacacactatattacgtaaataaacaagaaggaaaatcactttatgtcaaaggagaaccaataatcaatttctacgacccattagtattcccatcagacgaatttgatgcttcaatatcacaagtaaacgaaaaaataaatcaatcactcgcatttatacgaaaatcagacgaactactacacaatgtaaacgcaggcaaatcaacaacaaacataatgataacaacaataatcattgtaataatagtaatacttctatctctaatagcagtaggattactcctctactgcaaagcaagatcaacccctgtaacactatcaaaagaccaactttcaggtataaataatatagctttttccaattaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5374 - RNA, 1879 nt, synthetic construct
  misc_feature 1..1879: note = mRNA product Design a-5 comprising derived and/or modified sequence from HRSV(A2)__F_DSCav1_mut5 (opt11)
  source 1..1879: mol_type = other RNA
gggagactttcccattctgtagcagaatttggtgttgcctgtggtcttggtcccgcggagaagcttaccatggagctcctaatcctcaaagccaacgcgatcactacaatcctcacagccgtcaccttctgcttcgcctccggccaaaacatcaccgaggagttctaccaatcaacctgctccgccgtatcaaaaggatacctaagcgccctacggaccggctggtacacatctgtcatcaccatcgaactatcaaacatcaaagaaaacaaatgcaacggaaccgacgcaaaagtcaaactgattaaacaagaactagacaaatacaaaaacgcagtcaccgaactgcaattactcatgcaaagcacaccggccaccggctcaggcagcgccatcgcctccggcgtcgccgtctgcaaagttctccacctcgagggcgaagtcaacaaaataaaatctgccctcctctccaccaacaaagccgtcgtctccctcagcggctgcggagtctccgtcctcaccttcaaagttctcgatctcaagaactatattgacaaacaacttctacccatactcaacaaacaaagctgcagcatatccaacatcgaaaccgtcatcgagttccaacaaaagaacaaccgcctcctcgaaataacccgcgagttcagcgttaacgccggagtcactacccctgtctccacctacatgctcaccaactccgaactcctatcactaatcaacgacatgcccataaccaacgaccagaagaaactcatgtccaacaacgtccaaattgtccgacaacaaagctactccataatgtgcataataaaagaggaagtcctcgcctacgtcgtacaactgcccctttatggcgtaatcgacacaccctgctggaaactccacacgtcacccctctgcaccaccaacacaaaagaaggctcgaacatctgcctaacacggactgaccgcggctggtactgcgacaacgccggctccgtcagcttcttcccacaagccgaaacctgcaaagtacaatccaaccgagtattctgcgacaccatgaactccagaaccctcccctcagaggtcaacctgtgcaacgtagacatcttcaaccccaaatacgactgcaaaataatgacctcaaaaacagacgtctcctcttccgtaatcaccagcctcggagccatcgtcagctgctacggcaaaaccaaatgcaccgcctcaaacaaatgccgcggcatcatcaaaacattctcaaacggctgcgactacgtctccaacaaaggcgtcgacacagtaagcgtaggcaacacactgtactacgtcaacaaacaagagggaaaatcactctacgtcaaaggagaacccataatcaacttctacgaccccctcgttttccccagcgacgagttcgacgccagcatatcccaagtcaacgagaaaattaaccaatccctagcattcatccgaaaatctgacgaactgctccacaacgtcaacgcgggaaaatcaacaaccaacataatgataaccacaatcataatagtcatcatcgtaatcctcctcagcctaatcgctgtcggcctcctcctctactgcaaagcccgttccaccccagtcacactttccaaggaccaactaagcggaataaacaacatcgcgttctcaaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5375 - RNA, 2060 nt, synthetic construct
  misc_feature 1..2060: note = mRNA product Design b-1 comprising derived and/or modified sequence from HRSV(A2)__F_DSCav1_mut5 (opt1)
  source 1..2060: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5376 - RNA, 2060 nt, synthetic construct
  misc_feature 1..2060: note = mRNA product Design b-1 comprising derived and/or modified sequence from HRSV(A2)__F_DSCav1_mut5 (opt1)
  source 1..2060: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcgggtgcggcgtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggggtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggcgtgatcgacacgccgtgctggaagctgcacaccagccccctctgcaccaccaacacgaaggaggggtccaacatctgcctgacccgcaccgaccggggctggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggggccatcgtgtcctgctacggcaagaccaagtgcaccgccagcaacaagtgccgggggatcatcaagaccttctccaacggctgcgactacgtgagcaacaagggcgtcgacacggtgagcgtggggaacaccctctactacgtcaacaagcaggagggcaagtccctgtacgtgaagggggagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccggcaagtccaccaccaacatcatgatcaccacgatcatcatcgtgatcatcgtcatcctcctgagcctgatcgccgtggggctcctgctgtactgcaaggcccggtccaccccggtgaccctgagcaaggaccagctctccggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5377 - RNA, 2060 nt, synthetic construct
  misc_feature 1..2060: note = mRNA product Design b-1 comprising derived and/or modified sequence from HRSV(A2)__F_DSCav1_mut5 (opt2)
  source 1..2060: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5378 - RNA, 2060 nt, synthetic construct
  misc_feature 1..2060: note = mRNA product Design b-1 comprising derived and/or modified sequence from HRSV(A2)__F_DSCav1_mut5 (opt3)
  source 1..2060: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcggttgcggggtgtccgtattaacttttaaggttctggaccttaagaactacattgataaacaattgctgcctatcctaaataagcagtcatgtagtattagcaacatcgagaccgtgatagagttccagcagaaaaataacaggctcctggaaattacacgggagttttctgtcaatgcgggagtgactaccccagtgtccacatatatgcttaccaactcagaactgttgagcctcatcaatgacatgccgattacgaacgatcaaaagaaactgatgagtaacaatgtccagatcgttcgccagcagtcttactccatcatgtgcattataaaggaggaagtgttagcatatgtagtgcaactgcccctctacggcgtcatcgacactccttgttggaaacttcatacaagcccactgtgcaccactaacacaaaggagggctcgaatatttgtttgacccgaacggatcgtgggtggtactgcgacaacgccggatctgtgtccttctttccccaggctgaaacctgtaaggttcagtcaaatagagtgttctgcgatacaatgaacagtagaactctgcctagcgaggtcaatctctgcaacgtggacatctttaatccaaaatatgattgtaagataatgacctccaaaacagacgtatctagctcagttattaccagtctgggtgccatcgtgtcctgctacggcaagactaaatgtacagcaagcaacaagtgcagggggatcattaagaccttctctaatggatgtgattatgtctcaaacaaaggcgtggacactgtcagtgtgggtaatacgctttactatgttaacaagcaagaggggaaaagcctgtacgtgaagggagaacccatcattaatttttatgaccctttggtattcccatccgatgagtttgacgcttctatatcgcaggtcaacgagaaaatcaaccagagcctcgccttcattcggaagtccgatgaactgttacacaatgtgaacgcgggcaagtcaacaaccaatatcatgatcactaccattataatcgttattatcgtgattctgctaagtctcatcgccgtcggcctgcttttgtactgcaaagcacgctctacaccggtgaccctgagcaaggaccagctctccgggataaacaatatcgctttctcaaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5379 - RNA, 2060 nt, synthetic construct
  misc_feature 1..2060: note = mRNA product Design b-1 comprising derived and/or modified sequence from HRSV(A2)__F_DSCav1_mut5 (opt4)
  source 1..2060: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5380 - RNA, 2060 nt, synthetic construct
  misc_feature 1..2060: note = mRNA product Design b-1 comprising derived and/or modified sequence from HRSV(A2)__F_DSCav1_mut5 (opt5)
  source 1..2060: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcggatgcggcgtttctgtgctgacatttaaggtccttgacctgaagaactacattgataaacaactcctgcctatcctgaataagcagtcctgtagcatttctaacatcgagaccgtgattgagttccagcagaaaaataaccggctcctggaaatcacgcgcgagttttccgtgaatgccggcgtcacaaccccggttagcacatatatgcttaccaactccgaactgctctctctgatcaatgacatgcccattaccaacgatcaaaagaaacttatgagcaacaatgtgcagatcgtgagacagcagtcctacagcattatgtgcatcattaaggaggaagtcctggcttatgtggttcaactccctctgtacggggtgatcgacacaccctgttggaaactgcatacgtctcctctctgcaccacaaacaccaaggagggatccaatatctgtctgacacggaccgatcgcggctggtactgcgacaacgccgggagcgtctctttctttccccaggcggaaacgtgtaaggtgcagagcaatagagttttctgcgatacaatgaactccagaaccctgccttctgaggtgaatctctgcaacgtcgacatttttaatccgaaatatgattgtaagatcatgaccagcaaaacagacgtgtccagctctgtcattacctccctgggagccatcgtgagctgctacggcaagacaaaatgtacggcttctaacaagtgccgggggattatcaagaccttctccaatggatgtgattatgttagcaacaaaggcgtggacacagtctccgtgggcaataccctttactatgttaacaagcaagaggggaaatctctgtacgtgaagggagaacccatcattaatttttatgaccctctcgtcttccccagcgatgagtttgacgcctccatctctcaggtgaacgagaaaattaaccagagcctggctttcatccgcaagtccgatgaactgctccacaatgtgaacgccggcaagagcacaaccaatattatgatcacgaccattatcatcgttattatcgtcattctgctttctctgatcgccgtggggctcctgctgtactgcaaagctagatccacacctgtgacccttagcaaggaccagctctctggaattaacaatatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5381 - RNA, 2060 nt, synthetic construct
  misc_feature 1..2060: note = mRNA product Design b-1 comprising derived and/or modified sequence from HRSV(A2)__F_DSCav1_mut5 (opt6)
  source 1..2060: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggaactattaatacttaaagccaacgcaataacaacaattctcactgctgtcaccttctgcttcgcctcaggccaaaacataacggaagaattttaccaatcaacatgctctgcagtatccaaaggctacctatctgctctaagaacaggttggtatacatcagtaataaccatagaactatcaaacataaaagaaaataaatgcaacggaacagacgcaaaagttaaactcataaaacaagaactagacaaatataaaaacgcagttaccgaactacaactacttatgcaatccactcccgccactggatcaggatcagcaatagcatcaggagtcgcagtatgtaaagtcttacacctcgaaggcgaagtcaataaaatcaaatccgcattactatccacaaacaaagcagtcgtatccctaagcggatgcggagtatcagtactaacatttaaagtactagacctaaaaaattacatcgataaacaactattacctatattaaacaaacaatcctgctccatttcaaatatcgaaaccgtaatagaatttcaacaaaaaaacaacagattactagaaataacaagagaattttccgtaaatgctggcgtaacaacaccagtatccacatacatgctcacaaactccgaactactatcactaataaatgacatgcccataacaaacgatcaaaaaaaactaatgtcaaataatgtacaaatagtaagacaacaaagctactccatcatgtgtataataaaagaagaagtactagcatacgtagttcaactaccactttacggcgtaatcgacaccccttgctggaaactacacacctcccctctatgcaccacaaacacaaaagaaggttccaacatatgccttaccagaacagacagaggctggtattgcgacaacgcaggatcagtttcattttttccacaagctgaaacatgcaaagtacaatcaaacagagtcttctgcgacacaatgaactcaagaactctaccctcagaagtaaacctatgtaacgtagacattttcaaccccaaatacgactgcaaaattatgacatcaaaaacagacgtttcatcatcagttatcacctcattaggagcaatagtaagctgctacggaaaaacaaaatgcaccgcctcaaataaatgcagaggaataataaaaactttctccaacggatgcgactacgtttcaaacaaaggtgtagacactgtatcagtaggaaacacactatattacgtaaataaacaagaaggaaaatcactttatgtcaaaggagaaccaataatcaatttctacgacccattagtattcccatcagacgaatttgatgcttcaatatcacaagtaaacgaaaaaataaatcaatcactcgcatttatacgaaaatcagacgaactactacacaatgtaaacgcaggcaaatcaacaacaaacataatgataacaacaataatcattgtaataatagtaatacttctatctctaatagcagtaggattactcctctactgcaaagcaagatcaacccctgtaacactatcaaaagaccaactttcaggtataaataatatagctttttccaattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5382 - RNA, 2060 nt, synthetic construct
  misc_feature 1..2060: note = mRNA product Design b-1 comprising derived and/or modified sequence from HRSV(A2)__F_DSCav1_mut5 (opt11)
  source 1..2060: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctcctaatcctcaaagccaacgcgatcactacaatcctcacagccgtcaccttctgcttcgcctccggccaaaacatcaccgaggagttctaccaatcaacctgctccgccgtatcaaaaggatacctaagcgccctacggaccggctggtacacatctgtcatcaccatcgaactatcaaacatcaaagaaaacaaatgcaacggaaccgacgcaaaagtcaaactgattaaacaagaactagacaaatacaaaaacgcagtcaccgaactgcaattactcatgcaaagcacaccggccaccggctcaggcagcgccatcgcctccggcgtcgccgtctgcaaagttctccacctcgagggcgaagtcaacaaaataaaatctgccctcctctccaccaacaaagccgtcgtctccctcagcggctgcggagtctccgtcctcaccttcaaagttctcgatctcaagaactatattgacaaacaacttctacccatactcaacaaacaaagctgcagcatatccaacatcgaaaccgtcatcgagttccaacaaaagaacaaccgcctcctcgaaataacccgcgagttcagcgttaacgccggagtcactacccctgtctccacctacatgctcaccaactccgaactcctatcactaatcaacgacatgcccataaccaacgaccagaagaaactcatgtccaacaacgtccaaattgtccgacaacaaagctactccataatgtgcataataaaagaggaagtcctcgcctacgtcgtacaactgcccctttatggcgtaatcgacacaccctgctggaaactccacacgtcacccctctgcaccaccaacacaaaagaaggctcgaacatctgcctaacacggactgaccgcggctggtactgcgacaacgccggctccgtcagcttcttcccacaagccgaaacctgcaaagtacaatccaaccgagtattctgcgacaccatgaactccagaaccctcccctcagaggtcaacctgtgcaacgtagacatcttcaaccccaaatacgactgcaaaataatgacctcaaaaacagacgtctcctcttccgtaatcaccagcctcggagccatcgtcagctgctacggcaaaaccaaatgcaccgcctcaaacaaatgccgcggcatcatcaaaacattctcaaacggctgcgactacgtctccaacaaaggcgtcgacacagtaagcgtaggcaacacactgtactacgtcaacaaacaagagggaaaatcactctacgtcaaaggagaacccataatcaacttctacgaccccctcgttttccccagcgacgagttcgacgccagcatatcccaagtcaacgagaaaattaaccaatccctagcattcatccgaaaatctgacgaactgctccacaacgtcaacgcgggaaaatcaacaaccaacataatgataaccacaatcataatagtcatcatcgtaatcctcctcagcctaatcgctgtcggcctcctcctctactgcaaagcccgttccaccccagtcacactttccaaggaccaactaagcggaataaacaacatcgcgttctcaaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5383 - RNA, 1880 nt, synthetic construct
  misc_feature 1..1880: note = mRNA product Design b-2 comprising derived and/or modified sequence from HRSV(A2)__F_DSCav1_mut5 (opt1)
  source 1..1880: mol_type = other RNA
gggagagcctctgctggagtccggggagtggcgttggctgctagagcgaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5384 - RNA, 1880 nt, synthetic construct
  misc_feature 1..1880: note = mRNA product Design b-2 comprising derived and/or modified sequence from HRSV(A2)__F_DSCav1_mut5 (opt1)
  source 1..1880: mol_type = other RNA
gggagagcctctgctggagtccggggagtggcgttggctgctagagcgaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcgggtgcggcgtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggggtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggcgtgatcgacacgccgtgctggaagctgcacaccagccccctctgcaccaccaacacgaaggaggggtccaacatctgcctgacccgcaccgaccggggctggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggggccatcgtgtcctgctacggcaagaccaagtgcaccgccagcaacaagtgccgggggatcatcaagaccttctccaacggctgcgactacgtgagcaacaagggcgtcgacacggtgagcgtggggaacaccctctactacgtcaacaagcaggagggcaagtccctgtacgtgaagggggagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccggcaagtccaccaccaacatcatgatcaccacgatcatcatcgtgatcatcgtcatcctcctgagcctgatcgccgtggggctcctgctgtactgcaaggcccggtccaccccggtgaccctgagcaaggaccagctctccggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5385 - RNA, 1880 nt, synthetic construct
  misc_feature 1..1880: note = mRNA product Design b-2 comprising derived and/or modified sequence from HRSV(A2)__F_DSCav1_mut5 (opt2)
  source 1..1880: mol_type = other RNA
gggagagcctctgctggagtccggggagtggcgttggctgctagagcgaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5386 - RNA, 1880 nt, synthetic construct
  misc_feature 1..1880: note = mRNA product Design b-2 comprising derived and/or modified sequence from HRSV(A2)__F_DSCav1_mut5 (opt3)
  source 1..1880: mol_type = other RNA
gggagagcctctgctggagtccggggagtggcgttggctgctagagcgaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcggttgcggggtgtccgtattaacttttaaggttctggaccttaagaactacattgataaacaattgctgcctatcctaaataagcagtcatgtagtattagcaacatcgagaccgtgatagagttccagcagaaaaataacaggctcctggaaattacacgggagttttctgtcaatgcgggagtgactaccccagtgtccacatatatgcttaccaactcagaactgttgagcctcatcaatgacatgccgattacgaacgatcaaaagaaactgatgagtaacaatgtccagatcgttcgccagcagtcttactccatcatgtgcattataaaggaggaagtgttagcatatgtagtgcaactgcccctctacggcgtcatcgacactccttgttggaaacttcatacaagcccactgtgcaccactaacacaaaggagggctcgaatatttgtttgacccgaacggatcgtgggtggtactgcgacaacgccggatctgtgtccttctttccccaggctgaaacctgtaaggttcagtcaaatagagtgttctgcgatacaatgaacagtagaactctgcctagcgaggtcaatctctgcaacgtggacatctttaatccaaaatatgattgtaagataatgacctccaaaacagacgtatctagctcagttattaccagtctgggtgccatcgtgtcctgctacggcaagactaaatgtacagcaagcaacaagtgcagggggatcattaagaccttctctaatggatgtgattatgtctcaaacaaaggcgtggacactgtcagtgtgggtaatacgctttactatgttaacaagcaagaggggaaaagcctgtacgtgaagggagaacccatcattaatttttatgaccctttggtattcccatccgatgagtttgacgcttctatatcgcaggtcaacgagaaaatcaaccagagcctcgccttcattcggaagtccgatgaactgttacacaatgtgaacgcgggcaagtcaacaaccaatatcatgatcactaccattataatcgttattatcgtgattctgctaagtctcatcgccgtcggcctgcttttgtactgcaaagcacgctctacaccggtgaccctgagcaaggaccagctctccgggataaacaatatcgctttctcaaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5387 - RNA, 1880 nt, synthetic construct
  misc_feature 1..1880: note = mRNA product Design b-2 comprising derived and/or modified sequence from HRSV(A2)__F_DSCav1_mut5 (opt4)
  source 1..1880: mol_type = other RNA
gggagagcctctgctggagtccggggagtggcgttggctgctagagcgaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5388 - RNA, 1880 nt, synthetic construct
  misc_feature 1..1880: note = mRNA product Design b-2 comprising derived and/or modified sequence from HRSV(A2)__F_DSCav1_mut5 (opt5)
  source 1..1880: mol_type = other RNA
gggagagcctctgctggagtccggggagtggcgttggctgctagagcgaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcggatgcggcgtttctgtgctgacatttaaggtccttgacctgaagaactacattgataaacaactcctgcctatcctgaataagcagtcctgtagcatttctaacatcgagaccgtgattgagttccagcagaaaaataaccggctcctggaaatcacgcgcgagttttccgtgaatgccggcgtcacaaccccggttagcacatatatgcttaccaactccgaactgctctctctgatcaatgacatgcccattaccaacgatcaaaagaaacttatgagcaacaatgtgcagatcgtgagacagcagtcctacagcattatgtgcatcattaaggaggaagtcctggcttatgtggttcaactccctctgtacggggtgatcgacacaccctgttggaaactgcatacgtctcctctctgcaccacaaacaccaaggagggatccaatatctgtctgacacggaccgatcgcggctggtactgcgacaacgccgggagcgtctctttctttccccaggcggaaacgtgtaaggtgcagagcaatagagttttctgcgatacaatgaactccagaaccctgccttctgaggtgaatctctgcaacgtcgacatttttaatccgaaatatgattgtaagatcatgaccagcaaaacagacgtgtccagctctgtcattacctccctgggagccatcgtgagctgctacggcaagacaaaatgtacggcttctaacaagtgccgggggattatcaagaccttctccaatggatgtgattatgttagcaacaaaggcgtggacacagtctccgtgggcaataccctttactatgttaacaagcaagaggggaaatctctgtacgtgaagggagaacccatcattaatttttatgaccctctcgtcttccccagcgatgagtttgacgcctccatctctcaggtgaacgagaaaattaaccagagcctggctttcatccgcaagtccgatgaactgctccacaatgtgaacgccggcaagagcacaaccaatattatgatcacgaccattatcatcgttattatcgtcattctgctttctctgatcgccgtggggctcctgctgtactgcaaagctagatccacacctgtgacccttagcaaggaccagctctctggaattaacaatatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5389 - RNA, 1880 nt, synthetic construct
  misc_feature 1..1880: note = mRNA product Design b-2 comprising derived and/or modified sequence from HRSV(A2)__F_DSCav1_mut5 (opt6)
  source 1..1880: mol_type = other RNA
gggagagcctctgctggagtccggggagtggcgttggctgctagagcgaagcttaccatggaactattaatacttaaagccaacgcaataacaacaattctcactgctgtcaccttctgcttcgcctcaggccaaaacataacggaagaattttaccaatcaacatgctctgcagtatccaaaggctacctatctgctctaagaacaggttggtatacatcagtaataaccatagaactatcaaacataaaagaaaataaatgcaacggaacagacgcaaaagttaaactcataaaacaagaactagacaaatataaaaacgcagttaccgaactacaactacttatgcaatccactcccgccactggatcaggatcagcaatagcatcaggagtcgcagtatgtaaagtcttacacctcgaaggcgaagtcaataaaatcaaatccgcattactatccacaaacaaagcagtcgtatccctaagcggatgcggagtatcagtactaacatttaaagtactagacctaaaaaattacatcgataaacaactattacctatattaaacaaacaatcctgctccatttcaaatatcgaaaccgtaatagaatttcaacaaaaaaacaacagattactagaaataacaagagaattttccgtaaatgctggcgtaacaacaccagtatccacatacatgctcacaaactccgaactactatcactaataaatgacatgcccataacaaacgatcaaaaaaaactaatgtcaaataatgtacaaatagtaagacaacaaagctactccatcatgtgtataataaaagaagaagtactagcatacgtagttcaactaccactttacggcgtaatcgacaccccttgctggaaactacacacctcccctctatgcaccacaaacacaaaagaaggttccaacatatgccttaccagaacagacagaggctggtattgcgacaacgcaggatcagtttcattttttccacaagctgaaacatgcaaagtacaatcaaacagagtcttctgcgacacaatgaactcaagaactctaccctcagaagtaaacctatgtaacgtagacattttcaaccccaaatacgactgcaaaattatgacatcaaaaacagacgtttcatcatcagttatcacctcattaggagcaatagtaagctgctacggaaaaacaaaatgcaccgcctcaaataaatgcagaggaataataaaaactttctccaacggatgcgactacgtttcaaacaaaggtgtagacactgtatcagtaggaaacacactatattacgtaaataaacaagaaggaaaatcactttatgtcaaaggagaaccaataatcaatttctacgacccattagtattcccatcagacgaatttgatgcttcaatatcacaagtaaacgaaaaaataaatcaatcactcgcatttatacgaaaatcagacgaactactacacaatgtaaacgcaggcaaatcaacaacaaacataatgataacaacaataatcattgtaataatagtaatacttctatctctaatagcagtaggattactcctctactgcaaagcaagatcaacccctgtaacactatcaaaagaccaactttcaggtataaataatatagctttttccaattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5390 - RNA, 1880 nt, synthetic construct
  misc_feature 1..1880: note = mRNA product Design b-2 comprising derived and/or modified sequence from HRSV(A2)__F_DSCav1_mut5 (opt11)
  source 1..1880: mol_type = other RNA
gggagagcctctgctggagtccggggagtggcgttggctgctagagcgaagcttaccatggagctcctaatcctcaaagccaacgcgatcactacaatcctcacagccgtcaccttctgcttcgcctccggccaaaacatcaccgaggagttctaccaatcaacctgctccgccgtatcaaaaggatacctaagcgccctacggaccggctggtacacatctgtcatcaccatcgaactatcaaacatcaaagaaaacaaatgcaacggaaccgacgcaaaagtcaaactgattaaacaagaactagacaaatacaaaaacgcagtcaccgaactgcaattactcatgcaaagcacaccggccaccggctcaggcagcgccatcgcctccggcgtcgccgtctgcaaagttctccacctcgagggcgaagtcaacaaaataaaatctgccctcctctccaccaacaaagccgtcgtctccctcagcggctgcggagtctccgtcctcaccttcaaagttctcgatctcaagaactatattgacaaacaacttctacccatactcaacaaacaaagctgcagcatatccaacatcgaaaccgtcatcgagttccaacaaaagaacaaccgcctcctcgaaataacccgcgagttcagcgttaacgccggagtcactacccctgtctccacctacatgctcaccaactccgaactcctatcactaatcaacgacatgcccataaccaacgaccagaagaaactcatgtccaacaacgtccaaattgtccgacaacaaagctactccataatgtgcataataaaagaggaagtcctcgcctacgtcgtacaactgcccctttatggcgtaatcgacacaccctgctggaaactccacacgtcacccctctgcaccaccaacacaaaagaaggctcgaacatctgcctaacacggactgaccgcggctggtactgcgacaacgccggctccgtcagcttcttcccacaagccgaaacctgcaaagtacaatccaaccgagtattctgcgacaccatgaactccagaaccctcccctcagaggtcaacctgtgcaacgtagacatcttcaaccccaaatacgactgcaaaataatgacctcaaaaacagacgtctcctcttccgtaatcaccagcctcggagccatcgtcagctgctacggcaaaaccaaatgcaccgcctcaaacaaatgccgcggcatcatcaaaacattctcaaacggctgcgactacgtctccaacaaaggcgtcgacacagtaagcgtaggcaacacactgtactacgtcaacaaacaagagggaaaatcactctacgtcaaaggagaacccataatcaacttctacgaccccctcgttttccccagcgacgagttcgacgccagcatatcccaagtcaacgagaaaattaaccaatccctagcattcatccgaaaatctgacgaactgctccacaacgtcaacgcgggaaaatcaacaaccaacataatgataaccacaatcataatagtcatcatcgtaatcctcctcagcctaatcgctgtcggcctcctcctctactgcaaagcccgttccaccccagtcacactttccaaggaccaactaagcggaataaacaacatcgcgttctcaaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5391 - RNA, 1900 nt, synthetic construct
  misc_feature 1..1900: note = mRNA product Design b-3 comprising derived and/or modified sequence from HRSV(A2)__F_DSCav1_mut5 (opt1)
  source 1..1900: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5392 - RNA, 1900 nt, synthetic construct
  misc_feature 1..1900: note = mRNA product Design b-3 comprising derived and/or modified sequence from HRSV(A2)__F_DSCav1_mut5 (opt1)
  source 1..1900: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcgggtgcggcgtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggggtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggcgtgatcgacacgccgtgctggaagctgcacaccagccccctctgcaccaccaacacgaaggaggggtccaacatctgcctgacccgcaccgaccggggctggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggggccatcgtgtcctgctacggcaagaccaagtgcaccgccagcaacaagtgccgggggatcatcaagaccttctccaacggctgcgactacgtgagcaacaagggcgtcgacacggtgagcgtggggaacaccctctactacgtcaacaagcaggagggcaagtccctgtacgtgaagggggagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccggcaagtccaccaccaacatcatgatcaccacgatcatcatcgtgatcatcgtcatcctcctgagcctgatcgccgtggggctcctgctgtactgcaaggcccggtccaccccggtgaccctgagcaaggaccagctctccggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5393 - RNA, 1900 nt, synthetic construct
  misc_feature 1..1900: note = mRNA product Design b-3 comprising derived and/or modified sequence from HRSV(A2)__F_DSCav1_mut5 (opt2)
  source 1..1900: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5394 - RNA, 1900 nt, synthetic construct
  misc_feature 1..1900: note = mRNA product Design b-3 comprising derived and/or modified sequence from HRSV(A2)__F_DSCav1_mut5 (opt3)
  source 1..1900: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcggttgcggggtgtccgtattaacttttaaggttctggaccttaagaactacattgataaacaattgctgcctatcctaaataagcagtcatgtagtattagcaacatcgagaccgtgatagagttccagcagaaaaataacaggctcctggaaattacacgggagttttctgtcaatgcgggagtgactaccccagtgtccacatatatgcttaccaactcagaactgttgagcctcatcaatgacatgccgattacgaacgatcaaaagaaactgatgagtaacaatgtccagatcgttcgccagcagtcttactccatcatgtgcattataaaggaggaagtgttagcatatgtagtgcaactgcccctctacggcgtcatcgacactccttgttggaaacttcatacaagcccactgtgcaccactaacacaaaggagggctcgaatatttgtttgacccgaacggatcgtgggtggtactgcgacaacgccggatctgtgtccttctttccccaggctgaaacctgtaaggttcagtcaaatagagtgttctgcgatacaatgaacagtagaactctgcctagcgaggtcaatctctgcaacgtggacatctttaatccaaaatatgattgtaagataatgacctccaaaacagacgtatctagctcagttattaccagtctgggtgccatcgtgtcctgctacggcaagactaaatgtacagcaagcaacaagtgcagggggatcattaagaccttctctaatggatgtgattatgtctcaaacaaaggcgtggacactgtcagtgtgggtaatacgctttactatgttaacaagcaagaggggaaaagcctgtacgtgaagggagaacccatcattaatttttatgaccctttggtattcccatccgatgagtttgacgcttctatatcgcaggtcaacgagaaaatcaaccagagcctcgccttcattcggaagtccgatgaactgttacacaatgtgaacgcgggcaagtcaacaaccaatatcatgatcactaccattataatcgttattatcgtgattctgctaagtctcatcgccgtcggcctgcttttgtactgcaaagcacgctctacaccggtgaccctgagcaaggaccagctctccgggataaacaatatcgctttctcaaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5395 - RNA, 1900 nt, synthetic construct
  misc_feature 1..1900: note = mRNA product Design b-3 comprising derived and/or modified sequence from HRSV(A2)__F_DSCav1_mut5 (opt4)
  source 1..1900: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5396 - RNA, 1900 nt, synthetic construct
  misc_feature 1..1900: note = mRNA product Design b-3 comprising derived and/or modified sequence from HRSV(A2)__F_DSCav1_mut5 (opt5)
  source 1..1900: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcggatgcggcgtttctgtgctgacatttaaggtccttgacctgaagaactacattgataaacaactcctgcctatcctgaataagcagtcctgtagcatttctaacatcgagaccgtgattgagttccagcagaaaaataaccggctcctggaaatcacgcgcgagttttccgtgaatgccggcgtcacaaccccggttagcacatatatgcttaccaactccgaactgctctctctgatcaatgacatgcccattaccaacgatcaaaagaaacttatgagcaacaatgtgcagatcgtgagacagcagtcctacagcattatgtgcatcattaaggaggaagtcctggcttatgtggttcaactccctctgtacggggtgatcgacacaccctgttggaaactgcatacgtctcctctctgcaccacaaacaccaaggagggatccaatatctgtctgacacggaccgatcgcggctggtactgcgacaacgccgggagcgtctctttctttccccaggcggaaacgtgtaaggtgcagagcaatagagttttctgcgatacaatgaactccagaaccctgccttctgaggtgaatctctgcaacgtcgacatttttaatccgaaatatgattgtaagatcatgaccagcaaaacagacgtgtccagctctgtcattacctccctgggagccatcgtgagctgctacggcaagacaaaatgtacggcttctaacaagtgccgggggattatcaagaccttctccaatggatgtgattatgttagcaacaaaggcgtggacacagtctccgtgggcaataccctttactatgttaacaagcaagaggggaaatctctgtacgtgaagggagaacccatcattaatttttatgaccctctcgtcttccccagcgatgagtttgacgcctccatctctcaggtgaacgagaaaattaaccagagcctggctttcatccgcaagtccgatgaactgctccacaatgtgaacgccggcaagagcacaaccaatattatgatcacgaccattatcatcgttattatcgtcattctgctttctctgatcgccgtggggctcctgctgtactgcaaagctagatccacacctgtgacccttagcaaggaccagctctctggaattaacaatatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5397 - RNA, 1900 nt, synthetic construct
  misc_feature 1..1900: note = mRNA product Design b-3 comprising derived and/or modified sequence from HRSV(A2)__F_DSCav1_mut5 (opt6)
  source 1..1900: mol_type = other RNA
gggagagtcccgcagtcggcgtccagcggctctgcttgttcgtgtgtgtgtcgttgcaggccttattcaagcttaccatggaactattaatacttaaagccaacgcaataacaacaattctcactgctgtcaccttctgcttcgcctcaggccaaaacataacggaagaattttaccaatcaacatgctctgcagtatccaaaggctacctatctgctctaagaacaggttggtatacatcagtaataaccatagaactatcaaacataaaagaaaataaatgcaacggaacagacgcaaaagttaaactcataaaacaagaactagacaaatataaaaacgcagttaccgaactacaactacttatgcaatccactcccgccactggatcaggatcagcaatagcatcaggagtcgcagtatgtaaagtcttacacctcgaaggcgaagtcaataaaatcaaatccgcattactatccacaaacaaagcagtcgtatccctaagcggatgcggagtatcagtactaacatttaaagtactagacctaaaaaattacatcgataaacaactattacctatattaaacaaacaatcctgctccatttcaaatatcgaaaccgtaatagaatttcaacaaaaaaacaacagattactagaaataacaagagaattttccgtaaatgctggcgtaacaacaccagtatccacatacatgctcacaaactccgaactactatcactaataaatgacatgcccataacaaacgatcaaaaaaaactaatgtcaaataatgtacaaatagtaagacaacaaagctactccatcatgtgtataataaaagaagaagtactagcatacgtagttcaactaccactttacggcgtaatcgacaccccttgctggaaactacacacctcccctctatgcaccacaaacacaaaagaaggttccaacatatgccttaccagaacagacagaggctggtattgcgacaacgcaggatcagtttcattttttccacaagctgaaacatgcaaagtacaatcaaacagagtcttctgcgacacaatgaactcaagaactctaccctcagaagtaaacctatgtaacgtagacattttcaaccccaaatacgactgcaaaattatgacatcaaaaacagacgtttcatcatcagttatcacctcattaggagcaatagtaagctgctacggaaaaacaaaatgcaccgcctcaaataaatgcagaggaataataaaaactttctccaacggatgcgactacgtttcaaacaaaggtgtagacactgtatcagtaggaaacacactatattacgtaaataaacaagaaggaaaatcactttatgtcaaaggagaaccaataatcaatttctacgacccattagtattcccatcagacgaatttgatgcttcaatatcacaagtaaacgaaaaaataaatcaatcactcgcatttatacgaaaatcagacgaactactacacaatgtaaacgcaggcaaatcaacaacaaacataatgataacaacaataatcattgtaataatagtaatacttctatctctaatagcagtaggattactcctctactgcaaagcaagatcaacccctgtaacactatcaaaagaccaactttcaggtataaataatatagctttttccaattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5398 - RNA, 1900 nt, synthetic construct
  misc_feature 1..1900: note = mRNA product Design b-3 comprising derived and/or modified sequence from HRSV(A2)__F_DSCav1_mut5 (opt11)
  source 1..1900: mol_type = other RNA
gggagagtcccgcagtcggcgtccagcggctctgcttgttcgtgtgtgtgtcgttgcaggccttattcaagcttaccatggagctcctaatcctcaaagccaacgcgatcactacaatcctcacagccgtcaccttctgcttcgcctccggccaaaacatcaccgaggagttctaccaatcaacctgctccgccgtatcaaaaggatacctaagcgccctacggaccggctggtacacatctgtcatcaccatcgaactatcaaacatcaaagaaaacaaatgcaacggaaccgacgcaaaagtcaaactgattaaacaagaactagacaaatacaaaaacgcagtcaccgaactgcaattactcatgcaaagcacaccggccaccggctcaggcagcgccatcgcctccggcgtcgccgtctgcaaagttctccacctcgagggcgaagtcaacaaaataaaatctgccctcctctccaccaacaaagccgtcgtctccctcagcggctgcggagtctccgtcctcaccttcaaagttctcgatctcaagaactatattgacaaacaacttctacccatactcaacaaacaaagctgcagcatatccaacatcgaaaccgtcatcgagttccaacaaaagaacaaccgcctcctcgaaataacccgcgagttcagcgttaacgccggagtcactacccctgtctccacctacatgctcaccaactccgaactcctatcactaatcaacgacatgcccataaccaacgaccagaagaaactcatgtccaacaacgtccaaattgtccgacaacaaagctactccataatgtgcataataaaagaggaagtcctcgcctacgtcgtacaactgcccctttatggcgtaatcgacacaccctgctggaaactccacacgtcacccctctgcaccaccaacacaaaagaaggctcgaacatctgcctaacacggactgaccgcggctggtactgcgacaacgccggctccgtcagcttcttcccacaagccgaaacctgcaaagtacaatccaaccgagtattctgcgacaccatgaactccagaaccctcccctcagaggtcaacctgtgcaacgtagacatcttcaaccccaaatacgactgcaaaataatgacctcaaaaacagacgtctcctcttccgtaatcaccagcctcggagccatcgtcagctgctacggcaaaaccaaatgcaccgcctcaaacaaatgccgcggcatcatcaaaacattctcaaacggctgcgactacgtctccaacaaaggcgtcgacacagtaagcgtaggcaacacactgtactacgtcaacaaacaagagggaaaatcactctacgtcaaaggagaacccataatcaacttctacgaccccctcgttttccccagcgacgagttcgacgccagcatatcccaagtcaacgagaaaattaaccaatccctagcattcatccgaaaatctgacgaactgctccacaacgtcaacgcgggaaaatcaacaaccaacataatgataaccacaatcataatagtcatcatcgtaatcctcctcagcctaatcgctgtcggcctcctcctctactgcaaagcccgttccaccccagtcacactttccaaggaccaactaagcggaataaacaacatcgcgttctcaaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5399 - RNA, 1951 nt, synthetic construct
  misc_feature 1..1951: note = mRNA product Design b-4 comprising derived and/or modified sequence from HRSV(A2)__F_DSCav1_mut5 (opt1)
  source 1..1951: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5400 - RNA, 1951 nt, synthetic construct
  misc_feature 1..1951: note = mRNA product Design b-4 comprising derived and/or modified sequence from HRSV(A2)__F_DSCav1_mut5 (opt1)
  source 1..1951: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcgggtgcggcgtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggggtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggcgtgatcgacacgccgtgctggaagctgcacaccagccccctctgcaccaccaacacgaaggaggggtccaacatctgcctgacccgcaccgaccggggctggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggggccatcgtgtcctgctacggcaagaccaagtgcaccgccagcaacaagtgccgggggatcatcaagaccttctccaacggctgcgactacgtgagcaacaagggcgtcgacacggtgagcgtggggaacaccctctactacgtcaacaagcaggagggcaagtccctgtacgtgaagggggagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccggcaagtccaccaccaacatcatgatcaccacgatcatcatcgtgatcatcgtcatcctcctgagcctgatcgccgtggggctcctgctgtactgcaaggcccggtccaccccggtgaccctgagcaaggaccagctctccggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5401 - RNA, 1951 nt, synthetic construct
  misc_feature 1..1951: note = mRNA product Design b-4 comprising derived and/or modified sequence from HRSV(A2)__F_DSCav1_mut5 (opt2)
  source 1..1951: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5402 - RNA, 1951 nt, synthetic construct
  misc_feature 1..1951: note = mRNA product Design b-4 comprising derived and/or modified sequence from HRSV(A2)__F_DSCav1_mut5 (opt3)
  source 1..1951: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcggttgcggggtgtccgtattaacttttaaggttctggaccttaagaactacattgataaacaattgctgcctatcctaaataagcagtcatgtagtattagcaacatcgagaccgtgatagagttccagcagaaaaataacaggctcctggaaattacacgggagttttctgtcaatgcgggagtgactaccccagtgtccacatatatgcttaccaactcagaactgttgagcctcatcaatgacatgccgattacgaacgatcaaaagaaactgatgagtaacaatgtccagatcgttcgccagcagtcttactccatcatgtgcattataaaggaggaagtgttagcatatgtagtgcaactgcccctctacggcgtcatcgacactccttgttggaaacttcatacaagcccactgtgcaccactaacacaaaggagggctcgaatatttgtttgacccgaacggatcgtgggtggtactgcgacaacgccggatctgtgtccttctttccccaggctgaaacctgtaaggttcagtcaaatagagtgttctgcgatacaatgaacagtagaactctgcctagcgaggtcaatctctgcaacgtggacatctttaatccaaaatatgattgtaagataatgacctccaaaacagacgtatctagctcagttattaccagtctgggtgccatcgtgtcctgctacggcaagactaaatgtacagcaagcaacaagtgcagggggatcattaagaccttctctaatggatgtgattatgtctcaaacaaaggcgtggacactgtcagtgtgggtaatacgctttactatgttaacaagcaagaggggaaaagcctgtacgtgaagggagaacccatcattaatttttatgaccctttggtattcccatccgatgagtttgacgcttctatatcgcaggtcaacgagaaaatcaaccagagcctcgccttcattcggaagtccgatgaactgttacacaatgtgaacgcgggcaagtcaacaaccaatatcatgatcactaccattataatcgttattatcgtgattctgctaagtctcatcgccgtcggcctgcttttgtactgcaaagcacgctctacaccggtgaccctgagcaaggaccagctctccgggataaacaatatcgctttctcaaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5403 - RNA, 1951 nt, synthetic construct
  misc_feature 1..1951: note = mRNA product Design b-4 comprising derived and/or modified sequence from HRSV(A2)__F_DSCav1_mut5 (opt4)
  source 1..1951: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5404 - RNA, 1951 nt, synthetic construct
  misc_feature 1..1951: note = mRNA product Design b-4 comprising derived and/or modified sequence from HRSV(A2)__F_DSCav1_mut5 (opt5)
  source 1..1951: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcggatgcggcgtttctgtgctgacatttaaggtccttgacctgaagaactacattgataaacaactcctgcctatcctgaataagcagtcctgtagcatttctaacatcgagaccgtgattgagttccagcagaaaaataaccggctcctggaaatcacgcgcgagttttccgtgaatgccggcgtcacaaccccggttagcacatatatgcttaccaactccgaactgctctctctgatcaatgacatgcccattaccaacgatcaaaagaaacttatgagcaacaatgtgcagatcgtgagacagcagtcctacagcattatgtgcatcattaaggaggaagtcctggcttatgtggttcaactccctctgtacggggtgatcgacacaccctgttggaaactgcatacgtctcctctctgcaccacaaacaccaaggagggatccaatatctgtctgacacggaccgatcgcggctggtactgcgacaacgccgggagcgtctctttctttccccaggcggaaacgtgtaaggtgcagagcaatagagttttctgcgatacaatgaactccagaaccctgccttctgaggtgaatctctgcaacgtcgacatttttaatccgaaatatgattgtaagatcatgaccagcaaaacagacgtgtccagctctgtcattacctccctgggagccatcgtgagctgctacggcaagacaaaatgtacggcttctaacaagtgccgggggattatcaagaccttctccaatggatgtgattatgttagcaacaaaggcgtggacacagtctccgtgggcaataccctttactatgttaacaagcaagaggggaaatctctgtacgtgaagggagaacccatcattaatttttatgaccctctcgtcttccccagcgatgagtttgacgcctccatctctcaggtgaacgagaaaattaaccagagcctggctttcatccgcaagtccgatgaactgctccacaatgtgaacgccggcaagagcacaaccaatattatgatcacgaccattatcatcgttattatcgtcattctgctttctctgatcgccgtggggctcctgctgtactgcaaagctagatccacacctgtgacccttagcaaggaccagctctctggaattaacaatatcgcgttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5405 - RNA, 1951 nt, synthetic construct
  misc_feature 1..1951: note = mRNA product Design b-4 comprising derived and/or modified sequence from HRSV(A2)__F_DSCav1_mut5 (opt6)
  source 1..1951: mol_type = other RNA
gggagagtcccgcagtcggcgtccagcggctctgcttgttcgtgtgtgtgtcgttgcaggccttattcaagcttaccatggaactattaatacttaaagccaacgcaataacaacaattctcactgctgtcaccttctgcttcgcctcaggccaaaacataacggaagaattttaccaatcaacatgctctgcagtatccaaaggctacctatctgctctaagaacaggttggtatacatcagtaataaccatagaactatcaaacataaaagaaaataaatgcaacggaacagacgcaaaagttaaactcataaaacaagaactagacaaatataaaaacgcagttaccgaactacaactacttatgcaatccactcccgccactggatcaggatcagcaatagcatcaggagtcgcagtatgtaaagtcttacacctcgaaggcgaagtcaataaaatcaaatccgcattactatccacaaacaaagcagtcgtatccctaagcggatgcggagtatcagtactaacatttaaagtactagacctaaaaaattacatcgataaacaactattacctatattaaacaaacaatcctgctccatttcaaatatcgaaaccgtaatagaatttcaacaaaaaaacaacagattactagaaataacaagagaattttccgtaaatgctggcgtaacaacaccagtatccacatacatgctcacaaactccgaactactatcactaataaatgacatgcccataacaaacgatcaaaaaaaactaatgtcaaataatgtacaaatagtaagacaacaaagctactccatcatgtgtataataaaagaagaagtactagcatacgtagttcaactaccactttacggcgtaatcgacaccccttgctggaaactacacacctcccctctatgcaccacaaacacaaaagaaggttccaacatatgccttaccagaacagacagaggctggtattgcgacaacgcaggatcagtttcattttttccacaagctgaaacatgcaaagtacaatcaaacagagtcttctgcgacacaatgaactcaagaactctaccctcagaagtaaacctatgtaacgtagacattttcaaccccaaatacgactgcaaaattatgacatcaaaaacagacgtttcatcatcagttatcacctcattaggagcaatagtaagctgctacggaaaaacaaaatgcaccgcctcaaataaatgcagaggaataataaaaactttctccaacggatgcgactacgtttcaaacaaaggtgtagacactgtatcagtaggaaacacactatattacgtaaataaacaagaaggaaaatcactttatgtcaaaggagaaccaataatcaatttctacgacccattagtattcccatcagacgaatttgatgcttcaatatcacaagtaaacgaaaaaataaatcaatcactcgcatttatacgaaaatcagacgaactactacacaatgtaaacgcaggcaaatcaacaacaaacataatgataacaacaataatcattgtaataatagtaatacttctatctctaatagcagtaggattactcctctactgcaaagcaagatcaacccctgtaacactatcaaaagaccaactttcaggtataaataatatagctttttccaattaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5406 - RNA, 1951 nt, synthetic construct
  misc_feature 1..1951: note = mRNA product Design b-4 comprising derived and/or modified sequence from HRSV(A2)__F_DSCav1_mut5 (opt11)
  source 1..1951: mol_type = other RNA
gggagagtcccgcagtcggcgtccagcggctctgcttgttcgtgtgtgtgtcgttgcaggccttattcaagcttaccatggagctcctaatcctcaaagccaacgcgatcactacaatcctcacagccgtcaccttctgcttcgcctccggccaaaacatcaccgaggagttctaccaatcaacctgctccgccgtatcaaaaggatacctaagcgccctacggaccggctggtacacatctgtcatcaccatcgaactatcaaacatcaaagaaaacaaatgcaacggaaccgacgcaaaagtcaaactgattaaacaagaactagacaaatacaaaaacgcagtcaccgaactgcaattactcatgcaaagcacaccggccaccggctcaggcagcgccatcgcctccggcgtcgccgtctgcaaagttctccacctcgagggcgaagtcaacaaaataaaatctgccctcctctccaccaacaaagccgtcgtctccctcagcggctgcggagtctccgtcctcaccttcaaagttctcgatctcaagaactatattgacaaacaacttctacccatactcaacaaacaaagctgcagcatatccaacatcgaaaccgtcatcgagttccaacaaaagaacaaccgcctcctcgaaataacccgcgagttcagcgttaacgccggagtcactacccctgtctccacctacatgctcaccaactccgaactcctatcactaatcaacgacatgcccataaccaacgaccagaagaaactcatgtccaacaacgtccaaattgtccgacaacaaagctactccataatgtgcataataaaagaggaagtcctcgcctacgtcgtacaactgcccctttatggcgtaatcgacacaccctgctggaaactccacacgtcacccctctgcaccaccaacacaaaagaaggctcgaacatctgcctaacacggactgaccgcggctggtactgcgacaacgccggctccgtcagcttcttcccacaagccgaaacctgcaaagtacaatccaaccgagtattctgcgacaccatgaactccagaaccctcccctcagaggtcaacctgtgcaacgtagacatcttcaaccccaaatacgactgcaaaataatgacctcaaaaacagacgtctcctcttccgtaatcaccagcctcggagccatcgtcagctgctacggcaaaaccaaatgcaccgcctcaaacaaatgccgcggcatcatcaaaacattctcaaacggctgcgactacgtctccaacaaaggcgtcgacacagtaagcgtaggcaacacactgtactacgtcaacaaacaagagggaaaatcactctacgtcaaaggagaacccataatcaacttctacgaccccctcgttttccccagcgacgagttcgacgccagcatatcccaagtcaacgagaaaattaaccaatccctagcattcatccgaaaatctgacgaactgctccacaacgtcaacgcgggaaaatcaacaaccaacataatgataaccacaatcataatagtcatcatcgtaatcctcctcagcctaatcgctgtcggcctcctcctctactgcaaagcccgttccaccccagtcacactttccaaggaccaactaagcggaataaacaacatcgcgttctcaaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5407 - RNA, 2013 nt, synthetic construct
  misc_feature 1..2013: note = mRNA product Design b-5 comprising derived and/or modified sequence from HRSV(A2)__F_DSCav1_mut5 (opt1)
  source 1..2013: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5408 - RNA, 2013 nt, synthetic construct
  misc_feature 1..2013: note = mRNA product Design b-5 comprising derived and/or modified sequence from HRSV(A2)__F_DSCav1_mut5 (opt1)
  source 1..2013: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcgggtgcggcgtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggggtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggcgtgatcgacacgccgtgctggaagctgcacaccagccccctctgcaccaccaacacgaaggaggggtccaacatctgcctgacccgcaccgaccggggctggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggggccatcgtgtcctgctacggcaagaccaagtgcaccgccagcaacaagtgccgggggatcatcaagaccttctccaacggctgcgactacgtgagcaacaagggcgtcgacacggtgagcgtggggaacaccctctactacgtcaacaagcaggagggcaagtccctgtacgtgaagggggagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccggcaagtccaccaccaacatcatgatcaccacgatcatcatcgtgatcatcgtcatcctcctgagcctgatcgccgtggggctcctgctgtactgcaaggcccggtccaccccggtgaccctgagcaaggaccagctctccggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5409 - RNA, 2013 nt, synthetic construct
  misc_feature 1..2013: note = mRNA product Design b-5 comprising derived and/or modified sequence from HRSV(A2)__F_DSCav1_mut5 (opt2)
  source 1..2013: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5410 - RNA, 2013 nt, synthetic construct
  misc_feature 1..2013: note = mRNA product Design b-5 comprising derived and/or modified sequence from HRSV(A2)__F_DSCav1_mut5 (opt3)
  source 1..2013: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcggttgcggggtgtccgtattaacttttaaggttctggaccttaagaactacattgataaacaattgctgcctatcctaaataagcagtcatgtagtattagcaacatcgagaccgtgatagagttccagcagaaaaataacaggctcctggaaattacacgggagttttctgtcaatgcgggagtgactaccccagtgtccacatatatgcttaccaactcagaactgttgagcctcatcaatgacatgccgattacgaacgatcaaaagaaactgatgagtaacaatgtccagatcgttcgccagcagtcttactccatcatgtgcattataaaggaggaagtgttagcatatgtagtgcaactgcccctctacggcgtcatcgacactccttgttggaaacttcatacaagcccactgtgcaccactaacacaaaggagggctcgaatatttgtttgacccgaacggatcgtgggtggtactgcgacaacgccggatctgtgtccttctttccccaggctgaaacctgtaaggttcagtcaaatagagtgttctgcgatacaatgaacagtagaactctgcctagcgaggtcaatctctgcaacgtggacatctttaatccaaaatatgattgtaagataatgacctccaaaacagacgtatctagctcagttattaccagtctgggtgccatcgtgtcctgctacggcaagactaaatgtacagcaagcaacaagtgcagggggatcattaagaccttctctaatggatgtgattatgtctcaaacaaaggcgtggacactgtcagtgtgggtaatacgctttactatgttaacaagcaagaggggaaaagcctgtacgtgaagggagaacccatcattaatttttatgaccctttggtattcccatccgatgagtttgacgcttctatatcgcaggtcaacgagaaaatcaaccagagcctcgccttcattcggaagtccgatgaactgttacacaatgtgaacgcgggcaagtcaacaaccaatatcatgatcactaccattataatcgttattatcgtgattctgctaagtctcatcgccgtcggcctgcttttgtactgcaaagcacgctctacaccggtgaccctgagcaaggaccagctctccgggataaacaatatcgctttctcaaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5411 - RNA, 2013 nt, synthetic construct
  misc_feature 1..2013: note = mRNA product Design b-5 comprising derived and/or modified sequence from HRSV(A2)__F_DSCav1_mut5 (opt4)
  source 1..2013: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5412 - RNA, 2013 nt, synthetic construct
  misc_feature 1..2013: note = mRNA product Design b-5 comprising derived and/or modified sequence from HRSV(A2)__F_DSCav1_mut5 (opt5)
  source 1..2013: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcggatgcggcgtttctgtgctgacatttaaggtccttgacctgaagaactacattgataaacaactcctgcctatcctgaataagcagtcctgtagcatttctaacatcgagaccgtgattgagttccagcagaaaaataaccggctcctggaaatcacgcgcgagttttccgtgaatgccggcgtcacaaccccggttagcacatatatgcttaccaactccgaactgctctctctgatcaatgacatgcccattaccaacgatcaaaagaaacttatgagcaacaatgtgcagatcgtgagacagcagtcctacagcattatgtgcatcattaaggaggaagtcctggcttatgtggttcaactccctctgtacggggtgatcgacacaccctgttggaaactgcatacgtctcctctctgcaccacaaacaccaaggagggatccaatatctgtctgacacggaccgatcgcggctggtactgcgacaacgccgggagcgtctctttctttccccaggcggaaacgtgtaaggtgcagagcaatagagttttctgcgatacaatgaactccagaaccctgccttctgaggtgaatctctgcaacgtcgacatttttaatccgaaatatgattgtaagatcatgaccagcaaaacagacgtgtccagctctgtcattacctccctgggagccatcgtgagctgctacggcaagacaaaatgtacggcttctaacaagtgccgggggattatcaagaccttctccaatggatgtgattatgttagcaacaaaggcgtggacacagtctccgtgggcaataccctttactatgttaacaagcaagaggggaaatctctgtacgtgaagggagaacccatcattaatttttatgaccctctcgtcttccccagcgatgagtttgacgcctccatctctcaggtgaacgagaaaattaaccagagcctggctttcatccgcaagtccgatgaactgctccacaatgtgaacgccggcaagagcacaaccaatattatgatcacgaccattatcatcgttattatcgtcattctgctttctctgatcgccgtggggctcctgctgtactgcaaagctagatccacacctgtgacccttagcaaggaccagctctctggaattaacaatatcgcgttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5413 - RNA, 2013 nt, synthetic construct
  misc_feature 1..2013: note = mRNA product Design b-5 comprising derived and/or modified sequence from HRSV(A2)__F_DSCav1_mut5 (opt6)
  source 1..2013: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactattaatacttaaagccaacgcaataacaacaattctcactgctgtcaccttctgcttcgcctcaggccaaaacataacggaagaattttaccaatcaacatgctctgcagtatccaaaggctacctatctgctctaagaacaggttggtatacatcagtaataaccatagaactatcaaacataaaagaaaataaatgcaacggaacagacgcaaaagttaaactcataaaacaagaactagacaaatataaaaacgcagttaccgaactacaactacttatgcaatccactcccgccactggatcaggatcagcaatagcatcaggagtcgcagtatgtaaagtcttacacctcgaaggcgaagtcaataaaatcaaatccgcattactatccacaaacaaagcagtcgtatccctaagcggatgcggagtatcagtactaacatttaaagtactagacctaaaaaattacatcgataaacaactattacctatattaaacaaacaatcctgctccatttcaaatatcgaaaccgtaatagaatttcaacaaaaaaacaacagattactagaaataacaagagaattttccgtaaatgctggcgtaacaacaccagtatccacatacatgctcacaaactccgaactactatcactaataaatgacatgcccataacaaacgatcaaaaaaaactaatgtcaaataatgtacaaatagtaagacaacaaagctactccatcatgtgtataataaaagaagaagtactagcatacgtagttcaactaccactttacggcgtaatcgacaccccttgctggaaactacacacctcccctctatgcaccacaaacacaaaagaaggttccaacatatgccttaccagaacagacagaggctggtattgcgacaacgcaggatcagtttcattttttccacaagctgaaacatgcaaagtacaatcaaacagagtcttctgcgacacaatgaactcaagaactctaccctcagaagtaaacctatgtaacgtagacattttcaaccccaaatacgactgcaaaattatgacatcaaaaacagacgtttcatcatcagttatcacctcattaggagcaatagtaagctgctacggaaaaacaaaatgcaccgcctcaaataaatgcagaggaataataaaaactttctccaacggatgcgactacgtttcaaacaaaggtgtagacactgtatcagtaggaaacacactatattacgtaaataaacaagaaggaaaatcactttatgtcaaaggagaaccaataatcaatttctacgacccattagtattcccatcagacgaatttgatgcttcaatatcacaagtaaacgaaaaaataaatcaatcactcgcatttatacgaaaatcagacgaactactacacaatgtaaacgcaggcaaatcaacaacaaacataatgataacaacaataatcattgtaataatagtaatacttctatctctaatagcagtaggattactcctctactgcaaagcaagatcaacccctgtaacactatcaaaagaccaactttcaggtataaataatatagctttttccaattaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5414 - RNA, 2013 nt, synthetic construct
  misc_feature 1..2013: note = mRNA product Design b-5 comprising derived and/or modified sequence from HRSV(A2)__F_DSCav1_mut5 (opt11)
  source 1..2013: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctaatcctcaaagccaacgcgatcactacaatcctcacagccgtcaccttctgcttcgcctccggccaaaacatcaccgaggagttctaccaatcaacctgctccgccgtatcaaaaggatacctaagcgccctacggaccggctggtacacatctgtcatcaccatcgaactatcaaacatcaaagaaaacaaatgcaacggaaccgacgcaaaagtcaaactgattaaacaagaactagacaaatacaaaaacgcagtcaccgaactgcaattactcatgcaaagcacaccggccaccggctcaggcagcgccatcgcctccggcgtcgccgtctgcaaagttctccacctcgagggcgaagtcaacaaaataaaatctgccctcctctccaccaacaaagccgtcgtctccctcagcggctgcggagtctccgtcctcaccttcaaagttctcgatctcaagaactatattgacaaacaacttctacccatactcaacaaacaaagctgcagcatatccaacatcgaaaccgtcatcgagttccaacaaaagaacaaccgcctcctcgaaataacccgcgagttcagcgttaacgccggagtcactacccctgtctccacctacatgctcaccaactccgaactcctatcactaatcaacgacatgcccataaccaacgaccagaagaaactcatgtccaacaacgtccaaattgtccgacaacaaagctactccataatgtgcataataaaagaggaagtcctcgcctacgtcgtacaactgcccctttatggcgtaatcgacacaccctgctggaaactccacacgtcacccctctgcaccaccaacacaaaagaaggctcgaacatctgcctaacacggactgaccgcggctggtactgcgacaacgccggctccgtcagcttcttcccacaagccgaaacctgcaaagtacaatccaaccgagtattctgcgacaccatgaactccagaaccctcccctcagaggtcaacctgtgcaacgtagacatcttcaaccccaaatacgactgcaaaataatgacctcaaaaacagacgtctcctcttccgtaatcaccagcctcggagccatcgtcagctgctacggcaaaaccaaatgcaccgcctcaaacaaatgccgcggcatcatcaaaacattctcaaacggctgcgactacgtctccaacaaaggcgtcgacacagtaagcgtaggcaacacactgtactacgtcaacaaacaagagggaaaatcactctacgtcaaaggagaacccataatcaacttctacgaccccctcgttttccccagcgacgagttcgacgccagcatatcccaagtcaacgagaaaattaaccaatccctagcattcatccgaaaatctgacgaactgctccacaacgtcaacgcgggaaaatcaacaaccaacataatgataaccacaatcataatagtcatcatcgtaatcctcctcagcctaatcgctgtcggcctcctcctctactgcaaagcccgttccaccccagtcacactttccaaggaccaactaagcggaataaacaacatcgcgttctcaaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5415 - RNA, 1919 nt, synthetic construct
  misc_feature 1..1919: note = mRNA product Design c-1 comprising derived and/or modified sequence from HRSV(A2)__F_DSCav1_mut5 (opt1)
  source 1..1919: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5416 - RNA, 1919 nt, synthetic construct
  misc_feature 1..1919: note = mRNA product Design c-1 comprising derived and/or modified sequence from HRSV(A2)__F_DSCav1_mut5 (opt1)
  source 1..1919: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcgggtgcggcgtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggggtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggcgtgatcgacacgccgtgctggaagctgcacaccagccccctctgcaccaccaacacgaaggaggggtccaacatctgcctgacccgcaccgaccggggctggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggggccatcgtgtcctgctacggcaagaccaagtgcaccgccagcaacaagtgccgggggatcatcaagaccttctccaacggctgcgactacgtgagcaacaagggcgtcgacacggtgagcgtggggaacaccctctactacgtcaacaagcaggagggcaagtccctgtacgtgaagggggagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccggcaagtccaccaccaacatcatgatcaccacgatcatcatcgtgatcatcgtcatcctcctgagcctgatcgccgtggggctcctgctgtactgcaaggcccggtccaccccggtgaccctgagcaaggaccagctctccggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5417 - RNA, 1919 nt, synthetic construct
  misc_feature 1..1919: note = mRNA product Design c-1 comprising derived and/or modified sequence from HRSV(A2)__F_DSCav1_mut5 (opt2)
  source 1..1919: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5418 - RNA, 1919 nt, synthetic construct
  misc_feature 1..1919: note = mRNA product Design c-1 comprising derived and/or modified sequence from HRSV(A2)__F_DSCav1_mut5 (opt3)
  source 1..1919: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcggttgcggggtgtccgtattaacttttaaggttctggaccttaagaactacattgataaacaattgctgcctatcctaaataagcagtcatgtagtattagcaacatcgagaccgtgatagagttccagcagaaaaataacaggctcctggaaattacacgggagttttctgtcaatgcgggagtgactaccccagtgtccacatatatgcttaccaactcagaactgttgagcctcatcaatgacatgccgattacgaacgatcaaaagaaactgatgagtaacaatgtccagatcgttcgccagcagtcttactccatcatgtgcattataaaggaggaagtgttagcatatgtagtgcaactgcccctctacggcgtcatcgacactccttgttggaaacttcatacaagcccactgtgcaccactaacacaaaggagggctcgaatatttgtttgacccgaacggatcgtgggtggtactgcgacaacgccggatctgtgtccttctttccccaggctgaaacctgtaaggttcagtcaaatagagtgttctgcgatacaatgaacagtagaactctgcctagcgaggtcaatctctgcaacgtggacatctttaatccaaaatatgattgtaagataatgacctccaaaacagacgtatctagctcagttattaccagtctgggtgccatcgtgtcctgctacggcaagactaaatgtacagcaagcaacaagtgcagggggatcattaagaccttctctaatggatgtgattatgtctcaaacaaaggcgtggacactgtcagtgtgggtaatacgctttactatgttaacaagcaagaggggaaaagcctgtacgtgaagggagaacccatcattaatttttatgaccctttggtattcccatccgatgagtttgacgcttctatatcgcaggtcaacgagaaaatcaaccagagcctcgccttcattcggaagtccgatgaactgttacacaatgtgaacgcgggcaagtcaacaaccaatatcatgatcactaccattataatcgttattatcgtgattctgctaagtctcatcgccgtcggcctgcttttgtactgcaaagcacgctctacaccggtgaccctgagcaaggaccagctctccgggataaacaatatcgctttctcaaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5419 - RNA, 1919 nt, synthetic construct
  misc_feature 1..1919: note = mRNA product Design c-1 comprising derived and/or modified sequence from HRSV(A2)__F_DSCav1_mut5 (opt4)
  source 1..1919: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5420 - RNA, 1919 nt, synthetic construct
  misc_feature 1..1919: note = mRNA product Design c-1 comprising derived and/or modified sequence from HRSV(A2)__F_DSCav1_mut5 (opt5)
  source 1..1919: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcggatgcggcgtttctgtgctgacatttaaggtccttgacctgaagaactacattgataaacaactcctgcctatcctgaataagcagtcctgtagcatttctaacatcgagaccgtgattgagttccagcagaaaaataaccggctcctggaaatcacgcgcgagttttccgtgaatgccggcgtcacaaccccggttagcacatatatgcttaccaactccgaactgctctctctgatcaatgacatgcccattaccaacgatcaaaagaaacttatgagcaacaatgtgcagatcgtgagacagcagtcctacagcattatgtgcatcattaaggaggaagtcctggcttatgtggttcaactccctctgtacggggtgatcgacacaccctgttggaaactgcatacgtctcctctctgcaccacaaacaccaaggagggatccaatatctgtctgacacggaccgatcgcggctggtactgcgacaacgccgggagcgtctctttctttccccaggcggaaacgtgtaaggtgcagagcaatagagttttctgcgatacaatgaactccagaaccctgccttctgaggtgaatctctgcaacgtcgacatttttaatccgaaatatgattgtaagatcatgaccagcaaaacagacgtgtccagctctgtcattacctccctgggagccatcgtgagctgctacggcaagacaaaatgtacggcttctaacaagtgccgggggattatcaagaccttctccaatggatgtgattatgttagcaacaaaggcgtggacacagtctccgtgggcaataccctttactatgttaacaagcaagaggggaaatctctgtacgtgaagggagaacccatcattaatttttatgaccctctcgtcttccccagcgatgagtttgacgcctccatctctcaggtgaacgagaaaattaaccagagcctggctttcatccgcaagtccgatgaactgctccacaatgtgaacgccggcaagagcacaaccaatattatgatcacgaccattatcatcgttattatcgtcattctgctttctctgatcgccgtggggctcctgctgtactgcaaagctagatccacacctgtgacccttagcaaggaccagctctctggaattaacaatatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5421 - RNA, 1919 nt, synthetic construct
  misc_feature 1..1919: note = mRNA product Design c-1 comprising derived and/or modified sequence from HRSV(A2)__F_DSCav1_mut5 (opt6)
  source 1..1919: mol_type = other RNA
gggagagtccgctcagccaggttgcagaagcggcttagcgtgtgtcctaatcttctctctgcgtgtaggtaggcctgtgccgcaaacaagcttaccatggaactattaatacttaaagccaacgcaataacaacaattctcactgctgtcaccttctgcttcgcctcaggccaaaacataacggaagaattttaccaatcaacatgctctgcagtatccaaaggctacctatctgctctaagaacaggttggtatacatcagtaataaccatagaactatcaaacataaaagaaaataaatgcaacggaacagacgcaaaagttaaactcataaaacaagaactagacaaatataaaaacgcagttaccgaactacaactacttatgcaatccactcccgccactggatcaggatcagcaatagcatcaggagtcgcagtatgtaaagtcttacacctcgaaggcgaagtcaataaaatcaaatccgcattactatccacaaacaaagcagtcgtatccctaagcggatgcggagtatcagtactaacatttaaagtactagacctaaaaaattacatcgataaacaactattacctatattaaacaaacaatcctgctccatttcaaatatcgaaaccgtaatagaatttcaacaaaaaaacaacagattactagaaataacaagagaattttccgtaaatgctggcgtaacaacaccagtatccacatacatgctcacaaactccgaactactatcactaataaatgacatgcccataacaaacgatcaaaaaaaactaatgtcaaataatgtacaaatagtaagacaacaaagctactccatcatgtgtataataaaagaagaagtactagcatacgtagttcaactaccactttacggcgtaatcgacaccccttgctggaaactacacacctcccctctatgcaccacaaacacaaaagaaggttccaacatatgccttaccagaacagacagaggctggtattgcgacaacgcaggatcagtttcattttttccacaagctgaaacatgcaaagtacaatcaaacagagtcttctgcgacacaatgaactcaagaactctaccctcagaagtaaacctatgtaacgtagacattttcaaccccaaatacgactgcaaaattatgacatcaaaaacagacgtttcatcatcagttatcacctcattaggagcaatagtaagctgctacggaaaaacaaaatgcaccgcctcaaataaatgcagaggaataataaaaactttctccaacggatgcgactacgtttcaaacaaaggtgtagacactgtatcagtaggaaacacactatattacgtaaataaacaagaaggaaaatcactttatgtcaaaggagaaccaataatcaatttctacgacccattagtattcccatcagacgaatttgatgcttcaatatcacaagtaaacgaaaaaataaatcaatcactcgcatttatacgaaaatcagacgaactactacacaatgtaaacgcaggcaaatcaacaacaaacataatgataacaacaataatcattgtaataatagtaatacttctatctctaatagcagtaggattactcctctactgcaaagcaagatcaacccctgtaacactatcaaaagaccaactttcaggtataaataatatagctttttccaattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5422 - RNA, 1919 nt, synthetic construct
  misc_feature 1..1919: note = mRNA product Design c-1 comprising derived and/or modified sequence from HRSV(A2)__F_DSCav1_mut5 (opt11)
  source 1..1919: mol_type = other RNA
gggagagtccgctcagccaggttgcagaagcggcttagcgtgtgtcctaatcttctctctgcgtgtaggtaggcctgtgccgcaaacaagcttaccatggagctcctaatcctcaaagccaacgcgatcactacaatcctcacagccgtcaccttctgcttcgcctccggccaaaacatcaccgaggagttctaccaatcaacctgctccgccgtatcaaaaggatacctaagcgccctacggaccggctggtacacatctgtcatcaccatcgaactatcaaacatcaaagaaaacaaatgcaacggaaccgacgcaaaagtcaaactgattaaacaagaactagacaaatacaaaaacgcagtcaccgaactgcaattactcatgcaaagcacaccggccaccggctcaggcagcgccatcgcctccggcgtcgccgtctgcaaagttctccacctcgagggcgaagtcaacaaaataaaatctgccctcctctccaccaacaaagccgtcgtctccctcagcggctgcggagtctccgtcctcaccttcaaagttctcgatctcaagaactatattgacaaacaacttctacccatactcaacaaacaaagctgcagcatatccaacatcgaaaccgtcatcgagttccaacaaaagaacaaccgcctcctcgaaataacccgcgagttcagcgttaacgccggagtcactacccctgtctccacctacatgctcaccaactccgaactcctatcactaatcaacgacatgcccataaccaacgaccagaagaaactcatgtccaacaacgtccaaattgtccgacaacaaagctactccataatgtgcataataaaagaggaagtcctcgcctacgtcgtacaactgcccctttatggcgtaatcgacacaccctgctggaaactccacacgtcacccctctgcaccaccaacacaaaagaaggctcgaacatctgcctaacacggactgaccgcggctggtactgcgacaacgccggctccgtcagcttcttcccacaagccgaaacctgcaaagtacaatccaaccgagtattctgcgacaccatgaactccagaaccctcccctcagaggtcaacctgtgcaacgtagacatcttcaaccccaaatacgactgcaaaataatgacctcaaaaacagacgtctcctcttccgtaatcaccagcctcggagccatcgtcagctgctacggcaaaaccaaatgcaccgcctcaaacaaatgccgcggcatcatcaaaacattctcaaacggctgcgactacgtctccaacaaaggcgtcgacacagtaagcgtaggcaacacactgtactacgtcaacaaacaagagggaaaatcactctacgtcaaaggagaacccataatcaacttctacgaccccctcgttttccccagcgacgagttcgacgccagcatatcccaagtcaacgagaaaattaaccaatccctagcattcatccgaaaatctgacgaactgctccacaacgtcaacgcgggaaaatcaacaaccaacataatgataaccacaatcataatagtcatcatcgtaatcctcctcagcctaatcgctgtcggcctcctcctctactgcaaagcccgttccaccccagtcacactttccaaggaccaactaagcggaataaacaacatcgcgttctcaaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5423 - RNA, 2009 nt, synthetic construct
  misc_feature 1..2009: note = mRNA product Design c-2 comprising derived and/or modified sequence from HRSV(A2)__F_DSCav1_mut5 (opt1)
  source 1..2009: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5424 - RNA, 2009 nt, synthetic construct
  misc_feature 1..2009: note = mRNA product Design c-2 comprising derived and/or modified sequence from HRSV(A2)__F_DSCav1_mut5 (opt1)
  source 1..2009: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcgggtgcggcgtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggggtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggcgtgatcgacacgccgtgctggaagctgcacaccagccccctctgcaccaccaacacgaaggaggggtccaacatctgcctgacccgcaccgaccggggctggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggggccatcgtgtcctgctacggcaagaccaagtgcaccgccagcaacaagtgccgggggatcatcaagaccttctccaacggctgcgactacgtgagcaacaagggcgtcgacacggtgagcgtggggaacaccctctactacgtcaacaagcaggagggcaagtccctgtacgtgaagggggagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccggcaagtccaccaccaacatcatgatcaccacgatcatcatcgtgatcatcgtcatcctcctgagcctgatcgccgtggggctcctgctgtactgcaaggcccggtccaccccggtgaccctgagcaaggaccagctctccggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5425 - RNA, 2009 nt, synthetic construct
  misc_feature 1..2009: note = mRNA product Design c-2 comprising derived and/or modified sequence from HRSV(A2)__F_DSCav1_mut5 (opt2)
  source 1..2009: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5426 - RNA, 2009 nt, synthetic construct
  misc_feature 1..2009: note = mRNA product Design c-2 comprising derived and/or modified sequence from HRSV(A2)__F_DSCav1_mut5 (opt3)
  source 1..2009: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcggttgcggggtgtccgtattaacttttaaggttctggaccttaagaactacattgataaacaattgctgcctatcctaaataagcagtcatgtagtattagcaacatcgagaccgtgatagagttccagcagaaaaataacaggctcctggaaattacacgggagttttctgtcaatgcgggagtgactaccccagtgtccacatatatgcttaccaactcagaactgttgagcctcatcaatgacatgccgattacgaacgatcaaaagaaactgatgagtaacaatgtccagatcgttcgccagcagtcttactccatcatgtgcattataaaggaggaagtgttagcatatgtagtgcaactgcccctctacggcgtcatcgacactccttgttggaaacttcatacaagcccactgtgcaccactaacacaaaggagggctcgaatatttgtttgacccgaacggatcgtgggtggtactgcgacaacgccggatctgtgtccttctttccccaggctgaaacctgtaaggttcagtcaaatagagtgttctgcgatacaatgaacagtagaactctgcctagcgaggtcaatctctgcaacgtggacatctttaatccaaaatatgattgtaagataatgacctccaaaacagacgtatctagctcagttattaccagtctgggtgccatcgtgtcctgctacggcaagactaaatgtacagcaagcaacaagtgcagggggatcattaagaccttctctaatggatgtgattatgtctcaaacaaaggcgtggacactgtcagtgtgggtaatacgctttactatgttaacaagcaagaggggaaaagcctgtacgtgaagggagaacccatcattaatttttatgaccctttggtattcccatccgatgagtttgacgcttctatatcgcaggtcaacgagaaaatcaaccagagcctcgccttcattcggaagtccgatgaactgttacacaatgtgaacgcgggcaagtcaacaaccaatatcatgatcactaccattataatcgttattatcgtgattctgctaagtctcatcgccgtcggcctgcttttgtactgcaaagcacgctctacaccggtgaccctgagcaaggaccagctctccgggataaacaatatcgctttctcaaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5427 - RNA, 2009 nt, synthetic construct
  misc_feature 1..2009: note = mRNA product Design c-2 comprising derived and/or modified sequence from HRSV(A2)__F_DSCav1_mut5 (opt4)
  source 1..2009: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5428 - RNA, 2009 nt, synthetic construct
  misc_feature 1..2009: note = mRNA product Design c-2 comprising derived and/or modified sequence from HRSV(A2)__F_DSCav1_mut5 (opt5)
  source 1..2009: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcggatgcggcgtttctgtgctgacatttaaggtccttgacctgaagaactacattgataaacaactcctgcctatcctgaataagcagtcctgtagcatttctaacatcgagaccgtgattgagttccagcagaaaaataaccggctcctggaaatcacgcgcgagttttccgtgaatgccggcgtcacaaccccggttagcacatatatgcttaccaactccgaactgctctctctgatcaatgacatgcccattaccaacgatcaaaagaaacttatgagcaacaatgtgcagatcgtgagacagcagtcctacagcattatgtgcatcattaaggaggaagtcctggcttatgtggttcaactccctctgtacggggtgatcgacacaccctgttggaaactgcatacgtctcctctctgcaccacaaacaccaaggagggatccaatatctgtctgacacggaccgatcgcggctggtactgcgacaacgccgggagcgtctctttctttccccaggcggaaacgtgtaaggtgcagagcaatagagttttctgcgatacaatgaactccagaaccctgccttctgaggtgaatctctgcaacgtcgacatttttaatccgaaatatgattgtaagatcatgaccagcaaaacagacgtgtccagctctgtcattacctccctgggagccatcgtgagctgctacggcaagacaaaatgtacggcttctaacaagtgccgggggattatcaagaccttctccaatggatgtgattatgttagcaacaaaggcgtggacacagtctccgtgggcaataccctttactatgttaacaagcaagaggggaaatctctgtacgtgaagggagaacccatcattaatttttatgaccctctcgtcttccccagcgatgagtttgacgcctccatctctcaggtgaacgagaaaattaaccagagcctggctttcatccgcaagtccgatgaactgctccacaatgtgaacgccggcaagagcacaaccaatattatgatcacgaccattatcatcgttattatcgtcattctgctttctctgatcgccgtggggctcctgctgtactgcaaagctagatccacacctgtgacccttagcaaggaccagctctctggaattaacaatatcgcgttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5429 - RNA, 2009 nt, synthetic construct
  misc_feature 1..2009: note = mRNA product Design c-2 comprising derived and/or modified sequence from HRSV(A2)__F_DSCav1_mut5 (opt6)
  source 1..2009: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactattaatacttaaagccaacgcaataacaacaattctcactgctgtcaccttctgcttcgcctcaggccaaaacataacggaagaattttaccaatcaacatgctctgcagtatccaaaggctacctatctgctctaagaacaggttggtatacatcagtaataaccatagaactatcaaacataaaagaaaataaatgcaacggaacagacgcaaaagttaaactcataaaacaagaactagacaaatataaaaacgcagttaccgaactacaactacttatgcaatccactcccgccactggatcaggatcagcaatagcatcaggagtcgcagtatgtaaagtcttacacctcgaaggcgaagtcaataaaatcaaatccgcattactatccacaaacaaagcagtcgtatccctaagcggatgcggagtatcagtactaacatttaaagtactagacctaaaaaattacatcgataaacaactattacctatattaaacaaacaatcctgctccatttcaaatatcgaaaccgtaatagaatttcaacaaaaaaacaacagattactagaaataacaagagaattttccgtaaatgctggcgtaacaacaccagtatccacatacatgctcacaaactccgaactactatcactaataaatgacatgcccataacaaacgatcaaaaaaaactaatgtcaaataatgtacaaatagtaagacaacaaagctactccatcatgtgtataataaaagaagaagtactagcatacgtagttcaactaccactttacggcgtaatcgacaccccttgctggaaactacacacctcccctctatgcaccacaaacacaaaagaaggttccaacatatgccttaccagaacagacagaggctggtattgcgacaacgcaggatcagtttcattttttccacaagctgaaacatgcaaagtacaatcaaacagagtcttctgcgacacaatgaactcaagaactctaccctcagaagtaaacctatgtaacgtagacattttcaaccccaaatacgactgcaaaattatgacatcaaaaacagacgtttcatcatcagttatcacctcattaggagcaatagtaagctgctacggaaaaacaaaatgcaccgcctcaaataaatgcagaggaataataaaaactttctccaacggatgcgactacgtttcaaacaaaggtgtagacactgtatcagtaggaaacacactatattacgtaaataaacaagaaggaaaatcactttatgtcaaaggagaaccaataatcaatttctacgacccattagtattcccatcagacgaatttgatgcttcaatatcacaagtaaacgaaaaaataaatcaatcactcgcatttatacgaaaatcagacgaactactacacaatgtaaacgcaggcaaatcaacaacaaacataatgataacaacaataatcattgtaataatagtaatacttctatctctaatagcagtaggattactcctctactgcaaagcaagatcaacccctgtaacactatcaaaagaccaactttcaggtataaataatatagctttttccaattaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5430 - RNA, 2009 nt, synthetic construct
  misc_feature 1..2009: note = mRNA product Design c-2 comprising derived and/or modified sequence from HRSV(A2)__F_DSCav1_mut5 (opt11)
  source 1..2009: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctaatcctcaaagccaacgcgatcactacaatcctcacagccgtcaccttctgcttcgcctccggccaaaacatcaccgaggagttctaccaatcaacctgctccgccgtatcaaaaggatacctaagcgccctacggaccggctggtacacatctgtcatcaccatcgaactatcaaacatcaaagaaaacaaatgcaacggaaccgacgcaaaagtcaaactgattaaacaagaactagacaaatacaaaaacgcagtcaccgaactgcaattactcatgcaaagcacaccggccaccggctcaggcagcgccatcgcctccggcgtcgccgtctgcaaagttctccacctcgagggcgaagtcaacaaaataaaatctgccctcctctccaccaacaaagccgtcgtctccctcagcggctgcggagtctccgtcctcaccttcaaagttctcgatctcaagaactatattgacaaacaacttctacccatactcaacaaacaaagctgcagcatatccaacatcgaaaccgtcatcgagttccaacaaaagaacaaccgcctcctcgaaataacccgcgagttcagcgttaacgccggagtcactacccctgtctccacctacatgctcaccaactccgaactcctatcactaatcaacgacatgcccataaccaacgaccagaagaaactcatgtccaacaacgtccaaattgtccgacaacaaagctactccataatgtgcataataaaagaggaagtcctcgcctacgtcgtacaactgcccctttatggcgtaatcgacacaccctgctggaaactccacacgtcacccctctgcaccaccaacacaaaagaaggctcgaacatctgcctaacacggactgaccgcggctggtactgcgacaacgccggctccgtcagcttcttcccacaagccgaaacctgcaaagtacaatccaaccgagtattctgcgacaccatgaactccagaaccctcccctcagaggtcaacctgtgcaacgtagacatcttcaaccccaaatacgactgcaaaataatgacctcaaaaacagacgtctcctcttccgtaatcaccagcctcggagccatcgtcagctgctacggcaaaaccaaatgcaccgcctcaaacaaatgccgcggcatcatcaaaacattctcaaacggctgcgactacgtctccaacaaaggcgtcgacacagtaagcgtaggcaacacactgtactacgtcaacaaacaagagggaaaatcactctacgtcaaaggagaacccataatcaacttctacgaccccctcgttttccccagcgacgagttcgacgccagcatatcccaagtcaacgagaaaattaaccaatccctagcattcatccgaaaatctgacgaactgctccacaacgtcaacgcgggaaaatcaacaaccaacataatgataaccacaatcataatagtcatcatcgtaatcctcctcagcctaatcgctgtcggcctcctcctctactgcaaagcccgttccaccccagtcacactttccaaggaccaactaagcggaataaacaacatcgcgttctcaaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5431 - RNA, 1986 nt, synthetic construct
  misc_feature 1..1986: note = mRNA product Design c-3 comprising derived and/or modified sequence from HRSV(A2)__F_DSCav1_mut5 (opt1)
  source 1..1986: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5432 - RNA, 1986 nt, synthetic construct
  misc_feature 1..1986: note = mRNA product Design c-3 comprising derived and/or modified sequence from HRSV(A2)__F_DSCav1_mut5 (opt1)
  source 1..1986: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcgggtgcggcgtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggggtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggcgtgatcgacacgccgtgctggaagctgcacaccagccccctctgcaccaccaacacgaaggaggggtccaacatctgcctgacccgcaccgaccggggctggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggggccatcgtgtcctgctacggcaagaccaagtgcaccgccagcaacaagtgccgggggatcatcaagaccttctccaacggctgcgactacgtgagcaacaagggcgtcgacacggtgagcgtggggaacaccctctactacgtcaacaagcaggagggcaagtccctgtacgtgaagggggagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccggcaagtccaccaccaacatcatgatcaccacgatcatcatcgtgatcatcgtcatcctcctgagcctgatcgccgtggggctcctgctgtactgcaaggcccggtccaccccggtgaccctgagcaaggaccagctctccggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5433 - RNA, 1986 nt, synthetic construct
  misc_feature 1..1986: note = mRNA product Design c-3 comprising derived and/or modified sequence from HRSV(A2)__F_DSCav1_mut5 (opt2)
  source 1..1986: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5434 - RNA, 1986 nt, synthetic construct
  misc_feature 1..1986: note = mRNA product Design c-3 comprising derived and/or modified sequence from HRSV(A2)__F_DSCav1_mut5 (opt3)
  source 1..1986: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcggttgcggggtgtccgtattaacttttaaggttctggaccttaagaactacattgataaacaattgctgcctatcctaaataagcagtcatgtagtattagcaacatcgagaccgtgatagagttccagcagaaaaataacaggctcctggaaattacacgggagttttctgtcaatgcgggagtgactaccccagtgtccacatatatgcttaccaactcagaactgttgagcctcatcaatgacatgccgattacgaacgatcaaaagaaactgatgagtaacaatgtccagatcgttcgccagcagtcttactccatcatgtgcattataaaggaggaagtgttagcatatgtagtgcaactgcccctctacggcgtcatcgacactccttgttggaaacttcatacaagcccactgtgcaccactaacacaaaggagggctcgaatatttgtttgacccgaacggatcgtgggtggtactgcgacaacgccggatctgtgtccttctttccccaggctgaaacctgtaaggttcagtcaaatagagtgttctgcgatacaatgaacagtagaactctgcctagcgaggtcaatctctgcaacgtggacatctttaatccaaaatatgattgtaagataatgacctccaaaacagacgtatctagctcagttattaccagtctgggtgccatcgtgtcctgctacggcaagactaaatgtacagcaagcaacaagtgcagggggatcattaagaccttctctaatggatgtgattatgtctcaaacaaaggcgtggacactgtcagtgtgggtaatacgctttactatgttaacaagcaagaggggaaaagcctgtacgtgaagggagaacccatcattaatttttatgaccctttggtattcccatccgatgagtttgacgcttctatatcgcaggtcaacgagaaaatcaaccagagcctcgccttcattcggaagtccgatgaactgttacacaatgtgaacgcgggcaagtcaacaaccaatatcatgatcactaccattataatcgttattatcgtgattctgctaagtctcatcgccgtcggcctgcttttgtactgcaaagcacgctctacaccggtgaccctgagcaaggaccagctctccgggataaacaatatcgctttctcaaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5435 - RNA, 1986 nt, synthetic construct
  misc_feature 1..1986: note = mRNA product Design c-3 comprising derived and/or modified sequence from HRSV(A2)__F_DSCav1_mut5 (opt4)
  source 1..1986: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5436 - RNA, 1986 nt, synthetic construct
  misc_feature 1..1986: note = mRNA product Design c-3 comprising derived and/or modified sequence from HRSV(A2)__F_DSCav1_mut5 (opt5)
  source 1..1986: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcggatgcggcgtttctgtgctgacatttaaggtccttgacctgaagaactacattgataaacaactcctgcctatcctgaataagcagtcctgtagcatttctaacatcgagaccgtgattgagttccagcagaaaaataaccggctcctggaaatcacgcgcgagttttccgtgaatgccggcgtcacaaccccggttagcacatatatgcttaccaactccgaactgctctctctgatcaatgacatgcccattaccaacgatcaaaagaaacttatgagcaacaatgtgcagatcgtgagacagcagtcctacagcattatgtgcatcattaaggaggaagtcctggcttatgtggttcaactccctctgtacggggtgatcgacacaccctgttggaaactgcatacgtctcctctctgcaccacaaacaccaaggagggatccaatatctgtctgacacggaccgatcgcggctggtactgcgacaacgccgggagcgtctctttctttccccaggcggaaacgtgtaaggtgcagagcaatagagttttctgcgatacaatgaactccagaaccctgccttctgaggtgaatctctgcaacgtcgacatttttaatccgaaatatgattgtaagatcatgaccagcaaaacagacgtgtccagctctgtcattacctccctgggagccatcgtgagctgctacggcaagacaaaatgtacggcttctaacaagtgccgggggattatcaagaccttctccaatggatgtgattatgttagcaacaaaggcgtggacacagtctccgtgggcaataccctttactatgttaacaagcaagaggggaaatctctgtacgtgaagggagaacccatcattaatttttatgaccctctcgtcttccccagcgatgagtttgacgcctccatctctcaggtgaacgagaaaattaaccagagcctggctttcatccgcaagtccgatgaactgctccacaatgtgaacgccggcaagagcacaaccaatattatgatcacgaccattatcatcgttattatcgtcattctgctttctctgatcgccgtggggctcctgctgtactgcaaagctagatccacacctgtgacccttagcaaggaccagctctctggaattaacaatatcgcgttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5437 - RNA, 1986 nt, synthetic construct
  misc_feature 1..1986: note = mRNA product Design c-3 comprising derived and/or modified sequence from HRSV(A2)__F_DSCav1_mut5 (opt6)
  source 1..1986: mol_type = other RNA
gggagagtccgctcagccaggttgcagaagcggcttagcgtgtgtcctaatcttctctctgcgtgtaggtaggcctgtgccgcaaacaagcttaccatggaactattaatacttaaagccaacgcaataacaacaattctcactgctgtcaccttctgcttcgcctcaggccaaaacataacggaagaattttaccaatcaacatgctctgcagtatccaaaggctacctatctgctctaagaacaggttggtatacatcagtaataaccatagaactatcaaacataaaagaaaataaatgcaacggaacagacgcaaaagttaaactcataaaacaagaactagacaaatataaaaacgcagttaccgaactacaactacttatgcaatccactcccgccactggatcaggatcagcaatagcatcaggagtcgcagtatgtaaagtcttacacctcgaaggcgaagtcaataaaatcaaatccgcattactatccacaaacaaagcagtcgtatccctaagcggatgcggagtatcagtactaacatttaaagtactagacctaaaaaattacatcgataaacaactattacctatattaaacaaacaatcctgctccatttcaaatatcgaaaccgtaatagaatttcaacaaaaaaacaacagattactagaaataacaagagaattttccgtaaatgctggcgtaacaacaccagtatccacatacatgctcacaaactccgaactactatcactaataaatgacatgcccataacaaacgatcaaaaaaaactaatgtcaaataatgtacaaatagtaagacaacaaagctactccatcatgtgtataataaaagaagaagtactagcatacgtagttcaactaccactttacggcgtaatcgacaccccttgctggaaactacacacctcccctctatgcaccacaaacacaaaagaaggttccaacatatgccttaccagaacagacagaggctggtattgcgacaacgcaggatcagtttcattttttccacaagctgaaacatgcaaagtacaatcaaacagagtcttctgcgacacaatgaactcaagaactctaccctcagaagtaaacctatgtaacgtagacattttcaaccccaaatacgactgcaaaattatgacatcaaaaacagacgtttcatcatcagttatcacctcattaggagcaatagtaagctgctacggaaaaacaaaatgcaccgcctcaaataaatgcagaggaataataaaaactttctccaacggatgcgactacgtttcaaacaaaggtgtagacactgtatcagtaggaaacacactatattacgtaaataaacaagaaggaaaatcactttatgtcaaaggagaaccaataatcaatttctacgacccattagtattcccatcagacgaatttgatgcttcaatatcacaagtaaacgaaaaaataaatcaatcactcgcatttatacgaaaatcagacgaactactacacaatgtaaacgcaggcaaatcaacaacaaacataatgataacaacaataatcattgtaataatagtaatacttctatctctaatagcagtaggattactcctctactgcaaagcaagatcaacccctgtaacactatcaaaagaccaactttcaggtataaataatatagctttttccaattaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5438 - RNA, 1986 nt, synthetic construct
  misc_feature 1..1986: note = mRNA product Design c-3 comprising derived and/or modified sequence from HRSV(A2)__F_DSCav1_mut5 (opt11)
  source 1..1986: mol_type = other RNA
gggagagtccgctcagccaggttgcagaagcggcttagcgtgtgtcctaatcttctctctgcgtgtaggtaggcctgtgccgcaaacaagcttaccatggagctcctaatcctcaaagccaacgcgatcactacaatcctcacagccgtcaccttctgcttcgcctccggccaaaacatcaccgaggagttctaccaatcaacctgctccgccgtatcaaaaggatacctaagcgccctacggaccggctggtacacatctgtcatcaccatcgaactatcaaacatcaaagaaaacaaatgcaacggaaccgacgcaaaagtcaaactgattaaacaagaactagacaaatacaaaaacgcagtcaccgaactgcaattactcatgcaaagcacaccggccaccggctcaggcagcgccatcgcctccggcgtcgccgtctgcaaagttctccacctcgagggcgaagtcaacaaaataaaatctgccctcctctccaccaacaaagccgtcgtctccctcagcggctgcggagtctccgtcctcaccttcaaagttctcgatctcaagaactatattgacaaacaacttctacccatactcaacaaacaaagctgcagcatatccaacatcgaaaccgtcatcgagttccaacaaaagaacaaccgcctcctcgaaataacccgcgagttcagcgttaacgccggagtcactacccctgtctccacctacatgctcaccaactccgaactcctatcactaatcaacgacatgcccataaccaacgaccagaagaaactcatgtccaacaacgtccaaattgtccgacaacaaagctactccataatgtgcataataaaagaggaagtcctcgcctacgtcgtacaactgcccctttatggcgtaatcgacacaccctgctggaaactccacacgtcacccctctgcaccaccaacacaaaagaaggctcgaacatctgcctaacacggactgaccgcggctggtactgcgacaacgccggctccgtcagcttcttcccacaagccgaaacctgcaaagtacaatccaaccgagtattctgcgacaccatgaactccagaaccctcccctcagaggtcaacctgtgcaacgtagacatcttcaaccccaaatacgactgcaaaataatgacctcaaaaacagacgtctcctcttccgtaatcaccagcctcggagccatcgtcagctgctacggcaaaaccaaatgcaccgcctcaaacaaatgccgcggcatcatcaaaacattctcaaacggctgcgactacgtctccaacaaaggcgtcgacacagtaagcgtaggcaacacactgtactacgtcaacaaacaagagggaaaatcactctacgtcaaaggagaacccataatcaacttctacgaccccctcgttttccccagcgacgagttcgacgccagcatatcccaagtcaacgagaaaattaaccaatccctagcattcatccgaaaatctgacgaactgctccacaacgtcaacgcgggaaaatcaacaaccaacataatgataaccacaatcataatagtcatcatcgtaatcctcctcagcctaatcgctgtcggcctcctcctctactgcaaagcccgttccaccccagtcacactttccaaggaccaactaagcggaataaacaacatcgcgttctcaaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5439 - RNA, 1982 nt, synthetic construct
  misc_feature 1..1982: note = mRNA product Design c-4 comprising derived and/or modified sequence from HRSV(A2)__F_DSCav1_mut5 (opt1)
  source 1..1982: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5440 - RNA, 1982 nt, synthetic construct
  misc_feature 1..1982: note = mRNA product Design c-4 comprising derived and/or modified sequence from HRSV(A2)__F_DSCav1_mut5 (opt1)
  source 1..1982: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcgggtgcggcgtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggggtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggcgtgatcgacacgccgtgctggaagctgcacaccagccccctctgcaccaccaacacgaaggaggggtccaacatctgcctgacccgcaccgaccggggctggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggggccatcgtgtcctgctacggcaagaccaagtgcaccgccagcaacaagtgccgggggatcatcaagaccttctccaacggctgcgactacgtgagcaacaagggcgtcgacacggtgagcgtggggaacaccctctactacgtcaacaagcaggagggcaagtccctgtacgtgaagggggagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccggcaagtccaccaccaacatcatgatcaccacgatcatcatcgtgatcatcgtcatcctcctgagcctgatcgccgtggggctcctgctgtactgcaaggcccggtccaccccggtgaccctgagcaaggaccagctctccggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5441 - RNA, 1982 nt, synthetic construct
  misc_feature 1..1982: note = mRNA product Design c-4 comprising derived and/or modified sequence from HRSV(A2)__F_DSCav1_mut5 (opt2)
  source 1..1982: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5442 - RNA, 1982 nt, synthetic construct
  misc_feature 1..1982: note = mRNA product Design c-4 comprising derived and/or modified sequence from HRSV(A2)__F_DSCav1_mut5 (opt3)
  source 1..1982: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcggttgcggggtgtccgtattaacttttaaggttctggaccttaagaactacattgataaacaattgctgcctatcctaaataagcagtcatgtagtattagcaacatcgagaccgtgatagagttccagcagaaaaataacaggctcctggaaattacacgggagttttctgtcaatgcgggagtgactaccccagtgtccacatatatgcttaccaactcagaactgttgagcctcatcaatgacatgccgattacgaacgatcaaaagaaactgatgagtaacaatgtccagatcgttcgccagcagtcttactccatcatgtgcattataaaggaggaagtgttagcatatgtagtgcaactgcccctctacggcgtcatcgacactccttgttggaaacttcatacaagcccactgtgcaccactaacacaaaggagggctcgaatatttgtttgacccgaacggatcgtgggtggtactgcgacaacgccggatctgtgtccttctttccccaggctgaaacctgtaaggttcagtcaaatagagtgttctgcgatacaatgaacagtagaactctgcctagcgaggtcaatctctgcaacgtggacatctttaatccaaaatatgattgtaagataatgacctccaaaacagacgtatctagctcagttattaccagtctgggtgccatcgtgtcctgctacggcaagactaaatgtacagcaagcaacaagtgcagggggatcattaagaccttctctaatggatgtgattatgtctcaaacaaaggcgtggacactgtcagtgtgggtaatacgctttactatgttaacaagcaagaggggaaaagcctgtacgtgaagggagaacccatcattaatttttatgaccctttggtattcccatccgatgagtttgacgcttctatatcgcaggtcaacgagaaaatcaaccagagcctcgccttcattcggaagtccgatgaactgttacacaatgtgaacgcgggcaagtcaacaaccaatatcatgatcactaccattataatcgttattatcgtgattctgctaagtctcatcgccgtcggcctgcttttgtactgcaaagcacgctctacaccggtgaccctgagcaaggaccagctctccgggataaacaatatcgctttctcaaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5443 - RNA, 1982 nt, synthetic construct
  misc_feature 1..1982: note = mRNA product Design c-4 comprising derived and/or modified sequence from HRSV(A2)__F_DSCav1_mut5 (opt4)
  source 1..1982: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5444 - RNA, 1982 nt, synthetic construct
  misc_feature 1..1982: note = mRNA product Design c-4 comprising derived and/or modified sequence from HRSV(A2)__F_DSCav1_mut5 (opt5)
  source 1..1982: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcggatgcggcgtttctgtgctgacatttaaggtccttgacctgaagaactacattgataaacaactcctgcctatcctgaataagcagtcctgtagcatttctaacatcgagaccgtgattgagttccagcagaaaaataaccggctcctggaaatcacgcgcgagttttccgtgaatgccggcgtcacaaccccggttagcacatatatgcttaccaactccgaactgctctctctgatcaatgacatgcccattaccaacgatcaaaagaaacttatgagcaacaatgtgcagatcgtgagacagcagtcctacagcattatgtgcatcattaaggaggaagtcctggcttatgtggttcaactccctctgtacggggtgatcgacacaccctgttggaaactgcatacgtctcctctctgcaccacaaacaccaaggagggatccaatatctgtctgacacggaccgatcgcggctggtactgcgacaacgccgggagcgtctctttctttccccaggcggaaacgtgtaaggtgcagagcaatagagttttctgcgatacaatgaactccagaaccctgccttctgaggtgaatctctgcaacgtcgacatttttaatccgaaatatgattgtaagatcatgaccagcaaaacagacgtgtccagctctgtcattacctccctgggagccatcgtgagctgctacggcaagacaaaatgtacggcttctaacaagtgccgggggattatcaagaccttctccaatggatgtgattatgttagcaacaaaggcgtggacacagtctccgtgggcaataccctttactatgttaacaagcaagaggggaaatctctgtacgtgaagggagaacccatcattaatttttatgaccctctcgtcttccccagcgatgagtttgacgcctccatctctcaggtgaacgagaaaattaaccagagcctggctttcatccgcaagtccgatgaactgctccacaatgtgaacgccggcaagagcacaaccaatattatgatcacgaccattatcatcgttattatcgtcattctgctttctctgatcgccgtggggctcctgctgtactgcaaagctagatccacacctgtgacccttagcaaggaccagctctctggaattaacaatatcgcgttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5445 - RNA, 1982 nt, synthetic construct
  misc_feature 1..1982: note = mRNA product Design c-4 comprising derived and/or modified sequence from HRSV(A2)__F_DSCav1_mut5 (opt6)
  source 1..1982: mol_type = other RNA
gggagagtccgctcagccaggttgcagaagcggcttagcgtgtgtcctaatcttctctctgcgtgtaggtaggcctgtgccgcaaacaagcttaccatggaactattaatacttaaagccaacgcaataacaacaattctcactgctgtcaccttctgcttcgcctcaggccaaaacataacggaagaattttaccaatcaacatgctctgcagtatccaaaggctacctatctgctctaagaacaggttggtatacatcagtaataaccatagaactatcaaacataaaagaaaataaatgcaacggaacagacgcaaaagttaaactcataaaacaagaactagacaaatataaaaacgcagttaccgaactacaactacttatgcaatccactcccgccactggatcaggatcagcaatagcatcaggagtcgcagtatgtaaagtcttacacctcgaaggcgaagtcaataaaatcaaatccgcattactatccacaaacaaagcagtcgtatccctaagcggatgcggagtatcagtactaacatttaaagtactagacctaaaaaattacatcgataaacaactattacctatattaaacaaacaatcctgctccatttcaaatatcgaaaccgtaatagaatttcaacaaaaaaacaacagattactagaaataacaagagaattttccgtaaatgctggcgtaacaacaccagtatccacatacatgctcacaaactccgaactactatcactaataaatgacatgcccataacaaacgatcaaaaaaaactaatgtcaaataatgtacaaatagtaagacaacaaagctactccatcatgtgtataataaaagaagaagtactagcatacgtagttcaactaccactttacggcgtaatcgacaccccttgctggaaactacacacctcccctctatgcaccacaaacacaaaagaaggttccaacatatgccttaccagaacagacagaggctggtattgcgacaacgcaggatcagtttcattttttccacaagctgaaacatgcaaagtacaatcaaacagagtcttctgcgacacaatgaactcaagaactctaccctcagaagtaaacctatgtaacgtagacattttcaaccccaaatacgactgcaaaattatgacatcaaaaacagacgtttcatcatcagttatcacctcattaggagcaatagtaagctgctacggaaaaacaaaatgcaccgcctcaaataaatgcagaggaataataaaaactttctccaacggatgcgactacgtttcaaacaaaggtgtagacactgtatcagtaggaaacacactatattacgtaaataaacaagaaggaaaatcactttatgtcaaaggagaaccaataatcaatttctacgacccattagtattcccatcagacgaatttgatgcttcaatatcacaagtaaacgaaaaaataaatcaatcactcgcatttatacgaaaatcagacgaactactacacaatgtaaacgcaggcaaatcaacaacaaacataatgataacaacaataatcattgtaataatagtaatacttctatctctaatagcagtaggattactcctctactgcaaagcaagatcaacccctgtaacactatcaaaagaccaactttcaggtataaataatatagctttttccaattaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5446 - RNA, 1982 nt, synthetic construct
  misc_feature 1..1982: note = mRNA product Design c-4 comprising derived and/or modified sequence from HRSV(A2)__F_DSCav1_mut5 (opt11)
  source 1..1982: mol_type = other RNA
gggagagtccgctcagccaggttgcagaagcggcttagcgtgtgtcctaatcttctctctgcgtgtaggtaggcctgtgccgcaaacaagcttaccatggagctcctaatcctcaaagccaacgcgatcactacaatcctcacagccgtcaccttctgcttcgcctccggccaaaacatcaccgaggagttctaccaatcaacctgctccgccgtatcaaaaggatacctaagcgccctacggaccggctggtacacatctgtcatcaccatcgaactatcaaacatcaaagaaaacaaatgcaacggaaccgacgcaaaagtcaaactgattaaacaagaactagacaaatacaaaaacgcagtcaccgaactgcaattactcatgcaaagcacaccggccaccggctcaggcagcgccatcgcctccggcgtcgccgtctgcaaagttctccacctcgagggcgaagtcaacaaaataaaatctgccctcctctccaccaacaaagccgtcgtctccctcagcggctgcggagtctccgtcctcaccttcaaagttctcgatctcaagaactatattgacaaacaacttctacccatactcaacaaacaaagctgcagcatatccaacatcgaaaccgtcatcgagttccaacaaaagaacaaccgcctcctcgaaataacccgcgagttcagcgttaacgccggagtcactacccctgtctccacctacatgctcaccaactccgaactcctatcactaatcaacgacatgcccataaccaacgaccagaagaaactcatgtccaacaacgtccaaattgtccgacaacaaagctactccataatgtgcataataaaagaggaagtcctcgcctacgtcgtacaactgcccctttatggcgtaatcgacacaccctgctggaaactccacacgtcacccctctgcaccaccaacacaaaagaaggctcgaacatctgcctaacacggactgaccgcggctggtactgcgacaacgccggctccgtcagcttcttcccacaagccgaaacctgcaaagtacaatccaaccgagtattctgcgacaccatgaactccagaaccctcccctcagaggtcaacctgtgcaacgtagacatcttcaaccccaaatacgactgcaaaataatgacctcaaaaacagacgtctcctcttccgtaatcaccagcctcggagccatcgtcagctgctacggcaaaaccaaatgcaccgcctcaaacaaatgccgcggcatcatcaaaacattctcaaacggctgcgactacgtctccaacaaaggcgtcgacacagtaagcgtaggcaacacactgtactacgtcaacaaacaagagggaaaatcactctacgtcaaaggagaacccataatcaacttctacgaccccctcgttttccccagcgacgagttcgacgccagcatatcccaagtcaacgagaaaattaaccaatccctagcattcatccgaaaatctgacgaactgctccacaacgtcaacgcgggaaaatcaacaaccaacataatgataaccacaatcataatagtcatcatcgtaatcctcctcagcctaatcgctgtcggcctcctcctctactgcaaagcccgttccaccccagtcacactttccaaggaccaactaagcggaataaacaacatcgcgttctcaaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5447 - RNA, 1900 nt, synthetic construct
  misc_feature 1..1900: note = mRNA product Design c-5 comprising derived and/or modified sequence from HRSV(A2)__F_DSCav1_mut5 (opt1)
  source 1..1900: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5448 - RNA, 1900 nt, synthetic construct
  misc_feature 1..1900: note = mRNA product Design c-5 comprising derived and/or modified sequence from HRSV(A2)__F_DSCav1_mut5 (opt1)
  source 1..1900: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcgggtgcggcgtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggggtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggcgtgatcgacacgccgtgctggaagctgcacaccagccccctctgcaccaccaacacgaaggaggggtccaacatctgcctgacccgcaccgaccggggctggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggggccatcgtgtcctgctacggcaagaccaagtgcaccgccagcaacaagtgccgggggatcatcaagaccttctccaacggctgcgactacgtgagcaacaagggcgtcgacacggtgagcgtggggaacaccctctactacgtcaacaagcaggagggcaagtccctgtacgtgaagggggagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccggcaagtccaccaccaacatcatgatcaccacgatcatcatcgtgatcatcgtcatcctcctgagcctgatcgccgtggggctcctgctgtactgcaaggcccggtccaccccggtgaccctgagcaaggaccagctctccggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5449 - RNA, 1900 nt, synthetic construct
  misc_feature 1..1900: note = mRNA product Design c-5 comprising derived and/or modified sequence from HRSV(A2)__F_DSCav1_mut5 (opt2)
  source 1..1900: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5450 - RNA, 1900 nt, synthetic construct
  misc_feature 1..1900: note = mRNA product Design c-5 comprising derived and/or modified sequence from HRSV(A2)__F_DSCav1_mut5 (opt3)
  source 1..1900: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcggttgcggggtgtccgtattaacttttaaggttctggaccttaagaactacattgataaacaattgctgcctatcctaaataagcagtcatgtagtattagcaacatcgagaccgtgatagagttccagcagaaaaataacaggctcctggaaattacacgggagttttctgtcaatgcgggagtgactaccccagtgtccacatatatgcttaccaactcagaactgttgagcctcatcaatgacatgccgattacgaacgatcaaaagaaactgatgagtaacaatgtccagatcgttcgccagcagtcttactccatcatgtgcattataaaggaggaagtgttagcatatgtagtgcaactgcccctctacggcgtcatcgacactccttgttggaaacttcatacaagcccactgtgcaccactaacacaaaggagggctcgaatatttgtttgacccgaacggatcgtgggtggtactgcgacaacgccggatctgtgtccttctttccccaggctgaaacctgtaaggttcagtcaaatagagtgttctgcgatacaatgaacagtagaactctgcctagcgaggtcaatctctgcaacgtggacatctttaatccaaaatatgattgtaagataatgacctccaaaacagacgtatctagctcagttattaccagtctgggtgccatcgtgtcctgctacggcaagactaaatgtacagcaagcaacaagtgcagggggatcattaagaccttctctaatggatgtgattatgtctcaaacaaaggcgtggacactgtcagtgtgggtaatacgctttactatgttaacaagcaagaggggaaaagcctgtacgtgaagggagaacccatcattaatttttatgaccctttggtattcccatccgatgagtttgacgcttctatatcgcaggtcaacgagaaaatcaaccagagcctcgccttcattcggaagtccgatgaactgttacacaatgtgaacgcgggcaagtcaacaaccaatatcatgatcactaccattataatcgttattatcgtgattctgctaagtctcatcgccgtcggcctgcttttgtactgcaaagcacgctctacaccggtgaccctgagcaaggaccagctctccgggataaacaatatcgctttctcaaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5451 - RNA, 1900 nt, synthetic construct
  misc_feature 1..1900: note = mRNA product Design c-5 comprising derived and/or modified sequence from HRSV(A2)__F_DSCav1_mut5 (opt4)
  source 1..1900: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5452 - RNA, 1900 nt, synthetic construct
  misc_feature 1..1900: note = mRNA product Design c-5 comprising derived and/or modified sequence from HRSV(A2)__F_DSCav1_mut5 (opt5)
  source 1..1900: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcggatgcggcgtttctgtgctgacatttaaggtccttgacctgaagaactacattgataaacaactcctgcctatcctgaataagcagtcctgtagcatttctaacatcgagaccgtgattgagttccagcagaaaaataaccggctcctggaaatcacgcgcgagttttccgtgaatgccggcgtcacaaccccggttagcacatatatgcttaccaactccgaactgctctctctgatcaatgacatgcccattaccaacgatcaaaagaaacttatgagcaacaatgtgcagatcgtgagacagcagtcctacagcattatgtgcatcattaaggaggaagtcctggcttatgtggttcaactccctctgtacggggtgatcgacacaccctgttggaaactgcatacgtctcctctctgcaccacaaacaccaaggagggatccaatatctgtctgacacggaccgatcgcggctggtactgcgacaacgccgggagcgtctctttctttccccaggcggaaacgtgtaaggtgcagagcaatagagttttctgcgatacaatgaactccagaaccctgccttctgaggtgaatctctgcaacgtcgacatttttaatccgaaatatgattgtaagatcatgaccagcaaaacagacgtgtccagctctgtcattacctccctgggagccatcgtgagctgctacggcaagacaaaatgtacggcttctaacaagtgccgggggattatcaagaccttctccaatggatgtgattatgttagcaacaaaggcgtggacacagtctccgtgggcaataccctttactatgttaacaagcaagaggggaaatctctgtacgtgaagggagaacccatcattaatttttatgaccctctcgtcttccccagcgatgagtttgacgcctccatctctcaggtgaacgagaaaattaaccagagcctggctttcatccgcaagtccgatgaactgctccacaatgtgaacgccggcaagagcacaaccaatattatgatcacgaccattatcatcgttattatcgtcattctgctttctctgatcgccgtggggctcctgctgtactgcaaagctagatccacacctgtgacccttagcaaggaccagctctctggaattaacaatatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5453 - RNA, 1900 nt, synthetic construct
  misc_feature 1..1900: note = mRNA product Design c-5 comprising derived and/or modified sequence from HRSV(A2)__F_DSCav1_mut5 (opt6)
  source 1..1900: mol_type = other RNA
gggagagcggctcggccattttgtcccagtcagtccggaggctgcggctgcagaagtaccgcctgcggagtaactgcaaagaagcttaccatggaactattaatacttaaagccaacgcaataacaacaattctcactgctgtcaccttctgcttcgcctcaggccaaaacataacggaagaattttaccaatcaacatgctctgcagtatccaaaggctacctatctgctctaagaacaggttggtatacatcagtaataaccatagaactatcaaacataaaagaaaataaatgcaacggaacagacgcaaaagttaaactcataaaacaagaactagacaaatataaaaacgcagttaccgaactacaactacttatgcaatccactcccgccactggatcaggatcagcaatagcatcaggagtcgcagtatgtaaagtcttacacctcgaaggcgaagtcaataaaatcaaatccgcattactatccacaaacaaagcagtcgtatccctaagcggatgcggagtatcagtactaacatttaaagtactagacctaaaaaattacatcgataaacaactattacctatattaaacaaacaatcctgctccatttcaaatatcgaaaccgtaatagaatttcaacaaaaaaacaacagattactagaaataacaagagaattttccgtaaatgctggcgtaacaacaccagtatccacatacatgctcacaaactccgaactactatcactaataaatgacatgcccataacaaacgatcaaaaaaaactaatgtcaaataatgtacaaatagtaagacaacaaagctactccatcatgtgtataataaaagaagaagtactagcatacgtagttcaactaccactttacggcgtaatcgacaccccttgctggaaactacacacctcccctctatgcaccacaaacacaaaagaaggttccaacatatgccttaccagaacagacagaggctggtattgcgacaacgcaggatcagtttcattttttccacaagctgaaacatgcaaagtacaatcaaacagagtcttctgcgacacaatgaactcaagaactctaccctcagaagtaaacctatgtaacgtagacattttcaaccccaaatacgactgcaaaattatgacatcaaaaacagacgtttcatcatcagttatcacctcattaggagcaatagtaagctgctacggaaaaacaaaatgcaccgcctcaaataaatgcagaggaataataaaaactttctccaacggatgcgactacgtttcaaacaaaggtgtagacactgtatcagtaggaaacacactatattacgtaaataaacaagaaggaaaatcactttatgtcaaaggagaaccaataatcaatttctacgacccattagtattcccatcagacgaatttgatgcttcaatatcacaagtaaacgaaaaaataaatcaatcactcgcatttatacgaaaatcagacgaactactacacaatgtaaacgcaggcaaatcaacaacaaacataatgataacaacaataatcattgtaataatagtaatacttctatctctaatagcagtaggattactcctctactgcaaagcaagatcaacccctgtaacactatcaaaagaccaactttcaggtataaataatatagctttttccaattaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5454 - RNA, 1900 nt, synthetic construct
  misc_feature 1..1900: note = mRNA product Design c-5 comprising derived and/or modified sequence from HRSV(A2)__F_DSCav1_mut5 (opt11)
  source 1..1900: mol_type = other RNA
gggagagcggctcggccattttgtcccagtcagtccggaggctgcggctgcagaagtaccgcctgcggagtaactgcaaagaagcttaccatggagctcctaatcctcaaagccaacgcgatcactacaatcctcacagccgtcaccttctgcttcgcctccggccaaaacatcaccgaggagttctaccaatcaacctgctccgccgtatcaaaaggatacctaagcgccctacggaccggctggtacacatctgtcatcaccatcgaactatcaaacatcaaagaaaacaaatgcaacggaaccgacgcaaaagtcaaactgattaaacaagaactagacaaatacaaaaacgcagtcaccgaactgcaattactcatgcaaagcacaccggccaccggctcaggcagcgccatcgcctccggcgtcgccgtctgcaaagttctccacctcgagggcgaagtcaacaaaataaaatctgccctcctctccaccaacaaagccgtcgtctccctcagcggctgcggagtctccgtcctcaccttcaaagttctcgatctcaagaactatattgacaaacaacttctacccatactcaacaaacaaagctgcagcatatccaacatcgaaaccgtcatcgagttccaacaaaagaacaaccgcctcctcgaaataacccgcgagttcagcgttaacgccggagtcactacccctgtctccacctacatgctcaccaactccgaactcctatcactaatcaacgacatgcccataaccaacgaccagaagaaactcatgtccaacaacgtccaaattgtccgacaacaaagctactccataatgtgcataataaaagaggaagtcctcgcctacgtcgtacaactgcccctttatggcgtaatcgacacaccctgctggaaactccacacgtcacccctctgcaccaccaacacaaaagaaggctcgaacatctgcctaacacggactgaccgcggctggtactgcgacaacgccggctccgtcagcttcttcccacaagccgaaacctgcaaagtacaatccaaccgagtattctgcgacaccatgaactccagaaccctcccctcagaggtcaacctgtgcaacgtagacatcttcaaccccaaatacgactgcaaaataatgacctcaaaaacagacgtctcctcttccgtaatcaccagcctcggagccatcgtcagctgctacggcaaaaccaaatgcaccgcctcaaacaaatgccgcggcatcatcaaaacattctcaaacggctgcgactacgtctccaacaaaggcgtcgacacagtaagcgtaggcaacacactgtactacgtcaacaaacaagagggaaaatcactctacgtcaaaggagaacccataatcaacttctacgaccccctcgttttccccagcgacgagttcgacgccagcatatcccaagtcaacgagaaaattaaccaatccctagcattcatccgaaaatctgacgaactgctccacaacgtcaacgcgggaaaatcaacaaccaacataatgataaccacaatcataatagtcatcatcgtaatcctcctcagcctaatcgctgtcggcctcctcctctactgcaaagcccgttccaccccagtcacactttccaaggaccaactaagcggaataaacaacatcgcgttctcaaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5455 - RNA, 1909 nt, synthetic construct
  misc_feature 1..1909: note = mRNA product Design d-1 comprising derived and/or modified sequence from HRSV(A2)__F_DSCav1_mut5 (opt1)
  source 1..1909: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5456 - RNA, 1909 nt, synthetic construct
  misc_feature 1..1909: note = mRNA product Design d-1 comprising derived and/or modified sequence from HRSV(A2)__F_DSCav1_mut5 (opt1)
  source 1..1909: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcgggtgcggcgtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggggtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggcgtgatcgacacgccgtgctggaagctgcacaccagccccctctgcaccaccaacacgaaggaggggtccaacatctgcctgacccgcaccgaccggggctggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggggccatcgtgtcctgctacggcaagaccaagtgcaccgccagcaacaagtgccgggggatcatcaagaccttctccaacggctgcgactacgtgagcaacaagggcgtcgacacggtgagcgtggggaacaccctctactacgtcaacaagcaggagggcaagtccctgtacgtgaagggggagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccggcaagtccaccaccaacatcatgatcaccacgatcatcatcgtgatcatcgtcatcctcctgagcctgatcgccgtggggctcctgctgtactgcaaggcccggtccaccccggtgaccctgagcaaggaccagctctccggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5457 - RNA, 1909 nt, synthetic construct
  misc_feature 1..1909: note = mRNA product Design d-1 comprising derived and/or modified sequence from HRSV(A2)__F_DSCav1_mut5 (opt2)
  source 1..1909: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5458 - RNA, 1909 nt, synthetic construct
  misc_feature 1..1909: note = mRNA product Design d-1 comprising derived and/or modified sequence from HRSV(A2)__F_DSCav1_mut5 (opt3)
  source 1..1909: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcggttgcggggtgtccgtattaacttttaaggttctggaccttaagaactacattgataaacaattgctgcctatcctaaataagcagtcatgtagtattagcaacatcgagaccgtgatagagttccagcagaaaaataacaggctcctggaaattacacgggagttttctgtcaatgcgggagtgactaccccagtgtccacatatatgcttaccaactcagaactgttgagcctcatcaatgacatgccgattacgaacgatcaaaagaaactgatgagtaacaatgtccagatcgttcgccagcagtcttactccatcatgtgcattataaaggaggaagtgttagcatatgtagtgcaactgcccctctacggcgtcatcgacactccttgttggaaacttcatacaagcccactgtgcaccactaacacaaaggagggctcgaatatttgtttgacccgaacggatcgtgggtggtactgcgacaacgccggatctgtgtccttctttccccaggctgaaacctgtaaggttcagtcaaatagagtgttctgcgatacaatgaacagtagaactctgcctagcgaggtcaatctctgcaacgtggacatctttaatccaaaatatgattgtaagataatgacctccaaaacagacgtatctagctcagttattaccagtctgggtgccatcgtgtcctgctacggcaagactaaatgtacagcaagcaacaagtgcagggggatcattaagaccttctctaatggatgtgattatgtctcaaacaaaggcgtggacactgtcagtgtgggtaatacgctttactatgttaacaagcaagaggggaaaagcctgtacgtgaagggagaacccatcattaatttttatgaccctttggtattcccatccgatgagtttgacgcttctatatcgcaggtcaacgagaaaatcaaccagagcctcgccttcattcggaagtccgatgaactgttacacaatgtgaacgcgggcaagtcaacaaccaatatcatgatcactaccattataatcgttattatcgtgattctgctaagtctcatcgccgtcggcctgcttttgtactgcaaagcacgctctacaccggtgaccctgagcaaggaccagctctccgggataaacaatatcgctttctcaaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5459 - RNA, 1909 nt, synthetic construct
  misc_feature 1..1909: note = mRNA product Design d-1 comprising derived and/or modified sequence from HRSV(A2)__F_DSCav1_mut5 (opt4)
  source 1..1909: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5460 - RNA, 1909 nt, synthetic construct
  misc_feature 1..1909: note = mRNA product Design d-1 comprising derived and/or modified sequence from HRSV(A2)__F_DSCav1_mut5 (opt5)
  source 1..1909: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcggatgcggcgtttctgtgctgacatttaaggtccttgacctgaagaactacattgataaacaactcctgcctatcctgaataagcagtcctgtagcatttctaacatcgagaccgtgattgagttccagcagaaaaataaccggctcctggaaatcacgcgcgagttttccgtgaatgccggcgtcacaaccccggttagcacatatatgcttaccaactccgaactgctctctctgatcaatgacatgcccattaccaacgatcaaaagaaacttatgagcaacaatgtgcagatcgtgagacagcagtcctacagcattatgtgcatcattaaggaggaagtcctggcttatgtggttcaactccctctgtacggggtgatcgacacaccctgttggaaactgcatacgtctcctctctgcaccacaaacaccaaggagggatccaatatctgtctgacacggaccgatcgcggctggtactgcgacaacgccgggagcgtctctttctttccccaggcggaaacgtgtaaggtgcagagcaatagagttttctgcgatacaatgaactccagaaccctgccttctgaggtgaatctctgcaacgtcgacatttttaatccgaaatatgattgtaagatcatgaccagcaaaacagacgtgtccagctctgtcattacctccctgggagccatcgtgagctgctacggcaagacaaaatgtacggcttctaacaagtgccgggggattatcaagaccttctccaatggatgtgattatgttagcaacaaaggcgtggacacagtctccgtgggcaataccctttactatgttaacaagcaagaggggaaatctctgtacgtgaagggagaacccatcattaatttttatgaccctctcgtcttccccagcgatgagtttgacgcctccatctctcaggtgaacgagaaaattaaccagagcctggctttcatccgcaagtccgatgaactgctccacaatgtgaacgccggcaagagcacaaccaatattatgatcacgaccattatcatcgttattatcgtcattctgctttctctgatcgccgtggggctcctgctgtactgcaaagctagatccacacctgtgacccttagcaaggaccagctctctggaattaacaatatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5461 - RNA, 1909 nt, synthetic construct
  misc_feature 1..1909: note = mRNA product Design d-1 comprising derived and/or modified sequence from HRSV(A2)__F_DSCav1_mut5 (opt6)
  source 1..1909: mol_type = other RNA
gggagacccgtgacccggaagttgtacggctacgcgactttccctcccacaaaccctcgcgcccttcctttcctacttgggcccggcagaaagcttaccatggaactattaatacttaaagccaacgcaataacaacaattctcactgctgtcaccttctgcttcgcctcaggccaaaacataacggaagaattttaccaatcaacatgctctgcagtatccaaaggctacctatctgctctaagaacaggttggtatacatcagtaataaccatagaactatcaaacataaaagaaaataaatgcaacggaacagacgcaaaagttaaactcataaaacaagaactagacaaatataaaaacgcagttaccgaactacaactacttatgcaatccactcccgccactggatcaggatcagcaatagcatcaggagtcgcagtatgtaaagtcttacacctcgaaggcgaagtcaataaaatcaaatccgcattactatccacaaacaaagcagtcgtatccctaagcggatgcggagtatcagtactaacatttaaagtactagacctaaaaaattacatcgataaacaactattacctatattaaacaaacaatcctgctccatttcaaatatcgaaaccgtaatagaatttcaacaaaaaaacaacagattactagaaataacaagagaattttccgtaaatgctggcgtaacaacaccagtatccacatacatgctcacaaactccgaactactatcactaataaatgacatgcccataacaaacgatcaaaaaaaactaatgtcaaataatgtacaaatagtaagacaacaaagctactccatcatgtgtataataaaagaagaagtactagcatacgtagttcaactaccactttacggcgtaatcgacaccccttgctggaaactacacacctcccctctatgcaccacaaacacaaaagaaggttccaacatatgccttaccagaacagacagaggctggtattgcgacaacgcaggatcagtttcattttttccacaagctgaaacatgcaaagtacaatcaaacagagtcttctgcgacacaatgaactcaagaactctaccctcagaagtaaacctatgtaacgtagacattttcaaccccaaatacgactgcaaaattatgacatcaaaaacagacgtttcatcatcagttatcacctcattaggagcaatagtaagctgctacggaaaaacaaaatgcaccgcctcaaataaatgcagaggaataataaaaactttctccaacggatgcgactacgtttcaaacaaaggtgtagacactgtatcagtaggaaacacactatattacgtaaataaacaagaaggaaaatcactttatgtcaaaggagaaccaataatcaatttctacgacccattagtattcccatcagacgaatttgatgcttcaatatcacaagtaaacgaaaaaataaatcaatcactcgcatttatacgaaaatcagacgaactactacacaatgtaaacgcaggcaaatcaacaacaaacataatgataacaacaataatcattgtaataatagtaatacttctatctctaatagcagtaggattactcctctactgcaaagcaagatcaacccctgtaacactatcaaaagaccaactttcaggtataaataatatagctttttccaattaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5462 - RNA, 1909 nt, synthetic construct
  misc_feature 1..1909: note = mRNA product Design d-1 comprising derived and/or modified sequence from HRSV(A2)__F_DSCav1_mut5 (opt11)
  source 1..1909: mol_type = other RNA
gggagacccgtgacccggaagttgtacggctacgcgactttccctcccacaaaccctcgcgcccttcctttcctacttgggcccggcagaaagcttaccatggagctcctaatcctcaaagccaacgcgatcactacaatcctcacagccgtcaccttctgcttcgcctccggccaaaacatcaccgaggagttctaccaatcaacctgctccgccgtatcaaaaggatacctaagcgccctacggaccggctggtacacatctgtcatcaccatcgaactatcaaacatcaaagaaaacaaatgcaacggaaccgacgcaaaagtcaaactgattaaacaagaactagacaaatacaaaaacgcagtcaccgaactgcaattactcatgcaaagcacaccggccaccggctcaggcagcgccatcgcctccggcgtcgccgtctgcaaagttctccacctcgagggcgaagtcaacaaaataaaatctgccctcctctccaccaacaaagccgtcgtctccctcagcggctgcggagtctccgtcctcaccttcaaagttctcgatctcaagaactatattgacaaacaacttctacccatactcaacaaacaaagctgcagcatatccaacatcgaaaccgtcatcgagttccaacaaaagaacaaccgcctcctcgaaataacccgcgagttcagcgttaacgccggagtcactacccctgtctccacctacatgctcaccaactccgaactcctatcactaatcaacgacatgcccataaccaacgaccagaagaaactcatgtccaacaacgtccaaattgtccgacaacaaagctactccataatgtgcataataaaagaggaagtcctcgcctacgtcgtacaactgcccctttatggcgtaatcgacacaccctgctggaaactccacacgtcacccctctgcaccaccaacacaaaagaaggctcgaacatctgcctaacacggactgaccgcggctggtactgcgacaacgccggctccgtcagcttcttcccacaagccgaaacctgcaaagtacaatccaaccgagtattctgcgacaccatgaactccagaaccctcccctcagaggtcaacctgtgcaacgtagacatcttcaaccccaaatacgactgcaaaataatgacctcaaaaacagacgtctcctcttccgtaatcaccagcctcggagccatcgtcagctgctacggcaaaaccaaatgcaccgcctcaaacaaatgccgcggcatcatcaaaacattctcaaacggctgcgactacgtctccaacaaaggcgtcgacacagtaagcgtaggcaacacactgtactacgtcaacaaacaagagggaaaatcactctacgtcaaaggagaacccataatcaacttctacgaccccctcgttttccccagcgacgagttcgacgccagcatatcccaagtcaacgagaaaattaaccaatccctagcattcatccgaaaatctgacgaactgctccacaacgtcaacgcgggaaaatcaacaaccaacataatgataaccacaatcataatagtcatcatcgtaatcctcctcagcctaatcgctgtcggcctcctcctctactgcaaagcccgttccaccccagtcacactttccaaggaccaactaagcggaataaacaacatcgcgttctcaaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5463 - RNA, 1964 nt, synthetic construct
  misc_feature 1..1964: note = mRNA product Design d-2 comprising derived and/or modified sequence from HRSV(A2)__F_DSCav1_mut5 (opt1)
  source 1..1964: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5464 - RNA, 1964 nt, synthetic construct
  misc_feature 1..1964: note = mRNA product Design d-2 comprising derived and/or modified sequence from HRSV(A2)__F_DSCav1_mut5 (opt1)
  source 1..1964: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcgggtgcggcgtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggggtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggcgtgatcgacacgccgtgctggaagctgcacaccagccccctctgcaccaccaacacgaaggaggggtccaacatctgcctgacccgcaccgaccggggctggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggggccatcgtgtcctgctacggcaagaccaagtgcaccgccagcaacaagtgccgggggatcatcaagaccttctccaacggctgcgactacgtgagcaacaagggcgtcgacacggtgagcgtggggaacaccctctactacgtcaacaagcaggagggcaagtccctgtacgtgaagggggagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccggcaagtccaccaccaacatcatgatcaccacgatcatcatcgtgatcatcgtcatcctcctgagcctgatcgccgtggggctcctgctgtactgcaaggcccggtccaccccggtgaccctgagcaaggaccagctctccggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5465 - RNA, 1964 nt, synthetic construct
  misc_feature 1..1964: note = mRNA product Design d-2 comprising derived and/or modified sequence from HRSV(A2)__F_DSCav1_mut5 (opt2)
  source 1..1964: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5466 - RNA, 1964 nt, synthetic construct
  misc_feature 1..1964: note = mRNA product Design d-2 comprising derived and/or modified sequence from HRSV(A2)__F_DSCav1_mut5 (opt3)
  source 1..1964: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcggttgcggggtgtccgtattaacttttaaggttctggaccttaagaactacattgataaacaattgctgcctatcctaaataagcagtcatgtagtattagcaacatcgagaccgtgatagagttccagcagaaaaataacaggctcctggaaattacacgggagttttctgtcaatgcgggagtgactaccccagtgtccacatatatgcttaccaactcagaactgttgagcctcatcaatgacatgccgattacgaacgatcaaaagaaactgatgagtaacaatgtccagatcgttcgccagcagtcttactccatcatgtgcattataaaggaggaagtgttagcatatgtagtgcaactgcccctctacggcgtcatcgacactccttgttggaaacttcatacaagcccactgtgcaccactaacacaaaggagggctcgaatatttgtttgacccgaacggatcgtgggtggtactgcgacaacgccggatctgtgtccttctttccccaggctgaaacctgtaaggttcagtcaaatagagtgttctgcgatacaatgaacagtagaactctgcctagcgaggtcaatctctgcaacgtggacatctttaatccaaaatatgattgtaagataatgacctccaaaacagacgtatctagctcagttattaccagtctgggtgccatcgtgtcctgctacggcaagactaaatgtacagcaagcaacaagtgcagggggatcattaagaccttctctaatggatgtgattatgtctcaaacaaaggcgtggacactgtcagtgtgggtaatacgctttactatgttaacaagcaagaggggaaaagcctgtacgtgaagggagaacccatcattaatttttatgaccctttggtattcccatccgatgagtttgacgcttctatatcgcaggtcaacgagaaaatcaaccagagcctcgccttcattcggaagtccgatgaactgttacacaatgtgaacgcgggcaagtcaacaaccaatatcatgatcactaccattataatcgttattatcgtgattctgctaagtctcatcgccgtcggcctgcttttgtactgcaaagcacgctctacaccggtgaccctgagcaaggaccagctctccgggataaacaatatcgctttctcaaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5467 - RNA, 1964 nt, synthetic construct
  misc_feature 1..1964: note = mRNA product Design d-2 comprising derived and/or modified sequence from HRSV(A2)__F_DSCav1_mut5 (opt4)
  source 1..1964: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5468 - RNA, 1964 nt, synthetic construct
  misc_feature 1..1964: note = mRNA product Design d-2 comprising derived and/or modified sequence from HRSV(A2)__F_DSCav1_mut5 (opt5)
  source 1..1964: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcggatgcggcgtttctgtgctgacatttaaggtccttgacctgaagaactacattgataaacaactcctgcctatcctgaataagcagtcctgtagcatttctaacatcgagaccgtgattgagttccagcagaaaaataaccggctcctggaaatcacgcgcgagttttccgtgaatgccggcgtcacaaccccggttagcacatatatgcttaccaactccgaactgctctctctgatcaatgacatgcccattaccaacgatcaaaagaaacttatgagcaacaatgtgcagatcgtgagacagcagtcctacagcattatgtgcatcattaaggaggaagtcctggcttatgtggttcaactccctctgtacggggtgatcgacacaccctgttggaaactgcatacgtctcctctctgcaccacaaacaccaaggagggatccaatatctgtctgacacggaccgatcgcggctggtactgcgacaacgccgggagcgtctctttctttccccaggcggaaacgtgtaaggtgcagagcaatagagttttctgcgatacaatgaactccagaaccctgccttctgaggtgaatctctgcaacgtcgacatttttaatccgaaatatgattgtaagatcatgaccagcaaaacagacgtgtccagctctgtcattacctccctgggagccatcgtgagctgctacggcaagacaaaatgtacggcttctaacaagtgccgggggattatcaagaccttctccaatggatgtgattatgttagcaacaaaggcgtggacacagtctccgtgggcaataccctttactatgttaacaagcaagaggggaaatctctgtacgtgaagggagaacccatcattaatttttatgaccctctcgtcttccccagcgatgagtttgacgcctccatctctcaggtgaacgagaaaattaaccagagcctggctttcatccgcaagtccgatgaactgctccacaatgtgaacgccggcaagagcacaaccaatattatgatcacgaccattatcatcgttattatcgtcattctgctttctctgatcgccgtggggctcctgctgtactgcaaagctagatccacacctgtgacccttagcaaggaccagctctctggaattaacaatatcgcgttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5469 - RNA, 1964 nt, synthetic construct
  misc_feature 1..1964: note = mRNA product Design d-2 comprising derived and/or modified sequence from HRSV(A2)__F_DSCav1_mut5 (opt6)
  source 1..1964: mol_type = other RNA
gggagagcggctcggccattttgtcccagtcagtccggaggctgcggctgcagaagtaccgcctgcggagtaactgcaaagaagcttaccatggaactattaatacttaaagccaacgcaataacaacaattctcactgctgtcaccttctgcttcgcctcaggccaaaacataacggaagaattttaccaatcaacatgctctgcagtatccaaaggctacctatctgctctaagaacaggttggtatacatcagtaataaccatagaactatcaaacataaaagaaaataaatgcaacggaacagacgcaaaagttaaactcataaaacaagaactagacaaatataaaaacgcagttaccgaactacaactacttatgcaatccactcccgccactggatcaggatcagcaatagcatcaggagtcgcagtatgtaaagtcttacacctcgaaggcgaagtcaataaaatcaaatccgcattactatccacaaacaaagcagtcgtatccctaagcggatgcggagtatcagtactaacatttaaagtactagacctaaaaaattacatcgataaacaactattacctatattaaacaaacaatcctgctccatttcaaatatcgaaaccgtaatagaatttcaacaaaaaaacaacagattactagaaataacaagagaattttccgtaaatgctggcgtaacaacaccagtatccacatacatgctcacaaactccgaactactatcactaataaatgacatgcccataacaaacgatcaaaaaaaactaatgtcaaataatgtacaaatagtaagacaacaaagctactccatcatgtgtataataaaagaagaagtactagcatacgtagttcaactaccactttacggcgtaatcgacaccccttgctggaaactacacacctcccctctatgcaccacaaacacaaaagaaggttccaacatatgccttaccagaacagacagaggctggtattgcgacaacgcaggatcagtttcattttttccacaagctgaaacatgcaaagtacaatcaaacagagtcttctgcgacacaatgaactcaagaactctaccctcagaagtaaacctatgtaacgtagacattttcaaccccaaatacgactgcaaaattatgacatcaaaaacagacgtttcatcatcagttatcacctcattaggagcaatagtaagctgctacggaaaaacaaaatgcaccgcctcaaataaatgcagaggaataataaaaactttctccaacggatgcgactacgtttcaaacaaaggtgtagacactgtatcagtaggaaacacactatattacgtaaataaacaagaaggaaaatcactttatgtcaaaggagaaccaataatcaatttctacgacccattagtattcccatcagacgaatttgatgcttcaatatcacaagtaaacgaaaaaataaatcaatcactcgcatttatacgaaaatcagacgaactactacacaatgtaaacgcaggcaaatcaacaacaaacataatgataacaacaataatcattgtaataatagtaatacttctatctctaatagcagtaggattactcctctactgcaaagcaagatcaacccctgtaacactatcaaaagaccaactttcaggtataaataatatagctttttccaattaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5470 - RNA, 1964 nt, synthetic construct
  misc_feature 1..1964: note = mRNA product Design d-2 comprising derived and/or modified sequence from HRSV(A2)__F_DSCav1_mut5 (opt11)
  source 1..1964: mol_type = other RNA
gggagagcggctcggccattttgtcccagtcagtccggaggctgcggctgcagaagtaccgcctgcggagtaactgcaaagaagcttaccatggagctcctaatcctcaaagccaacgcgatcactacaatcctcacagccgtcaccttctgcttcgcctccggccaaaacatcaccgaggagttctaccaatcaacctgctccgccgtatcaaaaggatacctaagcgccctacggaccggctggtacacatctgtcatcaccatcgaactatcaaacatcaaagaaaacaaatgcaacggaaccgacgcaaaagtcaaactgattaaacaagaactagacaaatacaaaaacgcagtcaccgaactgcaattactcatgcaaagcacaccggccaccggctcaggcagcgccatcgcctccggcgtcgccgtctgcaaagttctccacctcgagggcgaagtcaacaaaataaaatctgccctcctctccaccaacaaagccgtcgtctccctcagcggctgcggagtctccgtcctcaccttcaaagttctcgatctcaagaactatattgacaaacaacttctacccatactcaacaaacaaagctgcagcatatccaacatcgaaaccgtcatcgagttccaacaaaagaacaaccgcctcctcgaaataacccgcgagttcagcgttaacgccggagtcactacccctgtctccacctacatgctcaccaactccgaactcctatcactaatcaacgacatgcccataaccaacgaccagaagaaactcatgtccaacaacgtccaaattgtccgacaacaaagctactccataatgtgcataataaaagaggaagtcctcgcctacgtcgtacaactgcccctttatggcgtaatcgacacaccctgctggaaactccacacgtcacccctctgcaccaccaacacaaaagaaggctcgaacatctgcctaacacggactgaccgcggctggtactgcgacaacgccggctccgtcagcttcttcccacaagccgaaacctgcaaagtacaatccaaccgagtattctgcgacaccatgaactccagaaccctcccctcagaggtcaacctgtgcaacgtagacatcttcaaccccaaatacgactgcaaaataatgacctcaaaaacagacgtctcctcttccgtaatcaccagcctcggagccatcgtcagctgctacggcaaaaccaaatgcaccgcctcaaacaaatgccgcggcatcatcaaaacattctcaaacggctgcgactacgtctccaacaaaggcgtcgacacagtaagcgtaggcaacacactgtactacgtcaacaaacaagagggaaaatcactctacgtcaaaggagaacccataatcaacttctacgaccccctcgttttccccagcgacgagttcgacgccagcatatcccaagtcaacgagaaaattaaccaatccctagcattcatccgaaaatctgacgaactgctccacaacgtcaacgcgggaaaatcaacaaccaacataatgataaccacaatcataatagtcatcatcgtaatcctcctcagcctaatcgctgtcggcctcctcctctactgcaaagcccgttccaccccagtcacactttccaaggaccaactaagcggaataaacaacatcgcgttctcaaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5471 - RNA, 2280 nt, synthetic construct
  misc_feature 1..2280: note = mRNA product Design d-3 comprising derived and/or modified sequence from HRSV(A2)__F_DSCav1_mut5 (opt1)
  source 1..2280: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5472 - RNA, 2280 nt, synthetic construct
  misc_feature 1..2280: note = mRNA product Design d-3 comprising derived and/or modified sequence from HRSV(A2)__F_DSCav1_mut5 (opt1)
  source 1..2280: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcgggtgcggcgtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggggtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggcgtgatcgacacgccgtgctggaagctgcacaccagccccctctgcaccaccaacacgaaggaggggtccaacatctgcctgacccgcaccgaccggggctggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggggccatcgtgtcctgctacggcaagaccaagtgcaccgccagcaacaagtgccgggggatcatcaagaccttctccaacggctgcgactacgtgagcaacaagggcgtcgacacggtgagcgtggggaacaccctctactacgtcaacaagcaggagggcaagtccctgtacgtgaagggggagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccggcaagtccaccaccaacatcatgatcaccacgatcatcatcgtgatcatcgtcatcctcctgagcctgatcgccgtggggctcctgctgtactgcaaggcccggtccaccccggtgaccctgagcaaggaccagctctccggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5473 - RNA, 2280 nt, synthetic construct
  misc_feature 1..2280: note = mRNA product Design d-3 comprising derived and/or modified sequence from HRSV(A2)__F_DSCav1_mut5 (opt2)
  source 1..2280: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5474 - RNA, 2280 nt, synthetic construct
  misc_feature 1..2280: note = mRNA product Design d-3 comprising derived and/or modified sequence from HRSV(A2)__F_DSCav1_mut5 (opt3)
  source 1..2280: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcggttgcggggtgtccgtattaacttttaaggttctggaccttaagaactacattgataaacaattgctgcctatcctaaataagcagtcatgtagtattagcaacatcgagaccgtgatagagttccagcagaaaaataacaggctcctggaaattacacgggagttttctgtcaatgcgggagtgactaccccagtgtccacatatatgcttaccaactcagaactgttgagcctcatcaatgacatgccgattacgaacgatcaaaagaaactgatgagtaacaatgtccagatcgttcgccagcagtcttactccatcatgtgcattataaaggaggaagtgttagcatatgtagtgcaactgcccctctacggcgtcatcgacactccttgttggaaacttcatacaagcccactgtgcaccactaacacaaaggagggctcgaatatttgtttgacccgaacggatcgtgggtggtactgcgacaacgccggatctgtgtccttctttccccaggctgaaacctgtaaggttcagtcaaatagagtgttctgcgatacaatgaacagtagaactctgcctagcgaggtcaatctctgcaacgtggacatctttaatccaaaatatgattgtaagataatgacctccaaaacagacgtatctagctcagttattaccagtctgggtgccatcgtgtcctgctacggcaagactaaatgtacagcaagcaacaagtgcagggggatcattaagaccttctctaatggatgtgattatgtctcaaacaaaggcgtggacactgtcagtgtgggtaatacgctttactatgttaacaagcaagaggggaaaagcctgtacgtgaagggagaacccatcattaatttttatgaccctttggtattcccatccgatgagtttgacgcttctatatcgcaggtcaacgagaaaatcaaccagagcctcgccttcattcggaagtccgatgaactgttacacaatgtgaacgcgggcaagtcaacaaccaatatcatgatcactaccattataatcgttattatcgtgattctgctaagtctcatcgccgtcggcctgcttttgtactgcaaagcacgctctacaccggtgaccctgagcaaggaccagctctccgggataaacaatatcgctttctcaaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5475 - RNA, 2280 nt, synthetic construct
  misc_feature 1..2280: note = mRNA product Design d-3 comprising derived and/or modified sequence from HRSV(A2)__F_DSCav1_mut5 (opt4)
  source 1..2280: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5476 - RNA, 2280 nt, synthetic construct
  misc_feature 1..2280: note = mRNA product Design d-3 comprising derived and/or modified sequence from HRSV(A2)__F_DSCav1_mut5 (opt5)
  source 1..2280: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcggatgcggcgtttctgtgctgacatttaaggtccttgacctgaagaactacattgataaacaactcctgcctatcctgaataagcagtcctgtagcatttctaacatcgagaccgtgattgagttccagcagaaaaataaccggctcctggaaatcacgcgcgagttttccgtgaatgccggcgtcacaaccccggttagcacatatatgcttaccaactccgaactgctctctctgatcaatgacatgcccattaccaacgatcaaaagaaacttatgagcaacaatgtgcagatcgtgagacagcagtcctacagcattatgtgcatcattaaggaggaagtcctggcttatgtggttcaactccctctgtacggggtgatcgacacaccctgttggaaactgcatacgtctcctctctgcaccacaaacaccaaggagggatccaatatctgtctgacacggaccgatcgcggctggtactgcgacaacgccgggagcgtctctttctttccccaggcggaaacgtgtaaggtgcagagcaatagagttttctgcgatacaatgaactccagaaccctgccttctgaggtgaatctctgcaacgtcgacatttttaatccgaaatatgattgtaagatcatgaccagcaaaacagacgtgtccagctctgtcattacctccctgggagccatcgtgagctgctacggcaagacaaaatgtacggcttctaacaagtgccgggggattatcaagaccttctccaatggatgtgattatgttagcaacaaaggcgtggacacagtctccgtgggcaataccctttactatgttaacaagcaagaggggaaatctctgtacgtgaagggagaacccatcattaatttttatgaccctctcgtcttccccagcgatgagtttgacgcctccatctctcaggtgaacgagaaaattaaccagagcctggctttcatccgcaagtccgatgaactgctccacaatgtgaacgccggcaagagcacaaccaatattatgatcacgaccattatcatcgttattatcgtcattctgctttctctgatcgccgtggggctcctgctgtactgcaaagctagatccacacctgtgacccttagcaaggaccagctctctggaattaacaatatcgcgttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5477 - RNA, 2280 nt, synthetic construct
  misc_feature 1..2280: note = mRNA product Design d-3 comprising derived and/or modified sequence from HRSV(A2)__F_DSCav1_mut5 (opt6)
  source 1..2280: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactattaatacttaaagccaacgcaataacaacaattctcactgctgtcaccttctgcttcgcctcaggccaaaacataacggaagaattttaccaatcaacatgctctgcagtatccaaaggctacctatctgctctaagaacaggttggtatacatcagtaataaccatagaactatcaaacataaaagaaaataaatgcaacggaacagacgcaaaagttaaactcataaaacaagaactagacaaatataaaaacgcagttaccgaactacaactacttatgcaatccactcccgccactggatcaggatcagcaatagcatcaggagtcgcagtatgtaaagtcttacacctcgaaggcgaagtcaataaaatcaaatccgcattactatccacaaacaaagcagtcgtatccctaagcggatgcggagtatcagtactaacatttaaagtactagacctaaaaaattacatcgataaacaactattacctatattaaacaaacaatcctgctccatttcaaatatcgaaaccgtaatagaatttcaacaaaaaaacaacagattactagaaataacaagagaattttccgtaaatgctggcgtaacaacaccagtatccacatacatgctcacaaactccgaactactatcactaataaatgacatgcccataacaaacgatcaaaaaaaactaatgtcaaataatgtacaaatagtaagacaacaaagctactccatcatgtgtataataaaagaagaagtactagcatacgtagttcaactaccactttacggcgtaatcgacaccccttgctggaaactacacacctcccctctatgcaccacaaacacaaaagaaggttccaacatatgccttaccagaacagacagaggctggtattgcgacaacgcaggatcagtttcattttttccacaagctgaaacatgcaaagtacaatcaaacagagtcttctgcgacacaatgaactcaagaactctaccctcagaagtaaacctatgtaacgtagacattttcaaccccaaatacgactgcaaaattatgacatcaaaaacagacgtttcatcatcagttatcacctcattaggagcaatagtaagctgctacggaaaaacaaaatgcaccgcctcaaataaatgcagaggaataataaaaactttctccaacggatgcgactacgtttcaaacaaaggtgtagacactgtatcagtaggaaacacactatattacgtaaataaacaagaaggaaaatcactttatgtcaaaggagaaccaataatcaatttctacgacccattagtattcccatcagacgaatttgatgcttcaatatcacaagtaaacgaaaaaataaatcaatcactcgcatttatacgaaaatcagacgaactactacacaatgtaaacgcaggcaaatcaacaacaaacataatgataacaacaataatcattgtaataatagtaatacttctatctctaatagcagtaggattactcctctactgcaaagcaagatcaacccctgtaacactatcaaaagaccaactttcaggtataaataatatagctttttccaattaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5478 - RNA, 2280 nt, synthetic construct
  misc_feature 1..2280: note = mRNA product Design d-3 comprising derived and/or modified sequence from HRSV(A2)__F_DSCav1_mut5 (opt11)
  source 1..2280: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctaatcctcaaagccaacgcgatcactacaatcctcacagccgtcaccttctgcttcgcctccggccaaaacatcaccgaggagttctaccaatcaacctgctccgccgtatcaaaaggatacctaagcgccctacggaccggctggtacacatctgtcatcaccatcgaactatcaaacatcaaagaaaacaaatgcaacggaaccgacgcaaaagtcaaactgattaaacaagaactagacaaatacaaaaacgcagtcaccgaactgcaattactcatgcaaagcacaccggccaccggctcaggcagcgccatcgcctccggcgtcgccgtctgcaaagttctccacctcgagggcgaagtcaacaaaataaaatctgccctcctctccaccaacaaagccgtcgtctccctcagcggctgcggagtctccgtcctcaccttcaaagttctcgatctcaagaactatattgacaaacaacttctacccatactcaacaaacaaagctgcagcatatccaacatcgaaaccgtcatcgagttccaacaaaagaacaaccgcctcctcgaaataacccgcgagttcagcgttaacgccggagtcactacccctgtctccacctacatgctcaccaactccgaactcctatcactaatcaacgacatgcccataaccaacgaccagaagaaactcatgtccaacaacgtccaaattgtccgacaacaaagctactccataatgtgcataataaaagaggaagtcctcgcctacgtcgtacaactgcccctttatggcgtaatcgacacaccctgctggaaactccacacgtcacccctctgcaccaccaacacaaaagaaggctcgaacatctgcctaacacggactgaccgcggctggtactgcgacaacgccggctccgtcagcttcttcccacaagccgaaacctgcaaagtacaatccaaccgagtattctgcgacaccatgaactccagaaccctcccctcagaggtcaacctgtgcaacgtagacatcttcaaccccaaatacgactgcaaaataatgacctcaaaaacagacgtctcctcttccgtaatcaccagcctcggagccatcgtcagctgctacggcaaaaccaaatgcaccgcctcaaacaaatgccgcggcatcatcaaaacattctcaaacggctgcgactacgtctccaacaaaggcgtcgacacagtaagcgtaggcaacacactgtactacgtcaacaaacaagagggaaaatcactctacgtcaaaggagaacccataatcaacttctacgaccccctcgttttccccagcgacgagttcgacgccagcatatcccaagtcaacgagaaaattaaccaatccctagcattcatccgaaaatctgacgaactgctccacaacgtcaacgcgggaaaatcaacaaccaacataatgataaccacaatcataatagtcatcatcgtaatcctcctcagcctaatcgctgtcggcctcctcctctactgcaaagcccgttccaccccagtcacactttccaaggaccaactaagcggaataaacaacatcgcgttctcaaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5479 - RNA, 1963 nt, synthetic construct
  misc_feature 1..1963: note = mRNA product Design d-4 comprising derived and/or modified sequence from HRSV(A2)__F_DSCav1_mut5 (opt1)
  source 1..1963: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5480 - RNA, 1963 nt, synthetic construct
  misc_feature 1..1963: note = mRNA product Design d-4 comprising derived and/or modified sequence from HRSV(A2)__F_DSCav1_mut5 (opt1)
  source 1..1963: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcgggtgcggcgtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggggtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggcgtgatcgacacgccgtgctggaagctgcacaccagccccctctgcaccaccaacacgaaggaggggtccaacatctgcctgacccgcaccgaccggggctggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggggccatcgtgtcctgctacggcaagaccaagtgcaccgccagcaacaagtgccgggggatcatcaagaccttctccaacggctgcgactacgtgagcaacaagggcgtcgacacggtgagcgtggggaacaccctctactacgtcaacaagcaggagggcaagtccctgtacgtgaagggggagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccggcaagtccaccaccaacatcatgatcaccacgatcatcatcgtgatcatcgtcatcctcctgagcctgatcgccgtggggctcctgctgtactgcaaggcccggtccaccccggtgaccctgagcaaggaccagctctccggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5481 - RNA, 1963 nt, synthetic construct
  misc_feature 1..1963: note = mRNA product Design d-4 comprising derived and/or modified sequence from HRSV(A2)__F_DSCav1_mut5 (opt2)
  source 1..1963: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5482 - RNA, 1963 nt, synthetic construct
  misc_feature 1..1963: note = mRNA product Design d-4 comprising derived and/or modified sequence from HRSV(A2)__F_DSCav1_mut5 (opt3)
  source 1..1963: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcggttgcggggtgtccgtattaacttttaaggttctggaccttaagaactacattgataaacaattgctgcctatcctaaataagcagtcatgtagtattagcaacatcgagaccgtgatagagttccagcagaaaaataacaggctcctggaaattacacgggagttttctgtcaatgcgggagtgactaccccagtgtccacatatatgcttaccaactcagaactgttgagcctcatcaatgacatgccgattacgaacgatcaaaagaaactgatgagtaacaatgtccagatcgttcgccagcagtcttactccatcatgtgcattataaaggaggaagtgttagcatatgtagtgcaactgcccctctacggcgtcatcgacactccttgttggaaacttcatacaagcccactgtgcaccactaacacaaaggagggctcgaatatttgtttgacccgaacggatcgtgggtggtactgcgacaacgccggatctgtgtccttctttccccaggctgaaacctgtaaggttcagtcaaatagagtgttctgcgatacaatgaacagtagaactctgcctagcgaggtcaatctctgcaacgtggacatctttaatccaaaatatgattgtaagataatgacctccaaaacagacgtatctagctcagttattaccagtctgggtgccatcgtgtcctgctacggcaagactaaatgtacagcaagcaacaagtgcagggggatcattaagaccttctctaatggatgtgattatgtctcaaacaaaggcgtggacactgtcagtgtgggtaatacgctttactatgttaacaagcaagaggggaaaagcctgtacgtgaagggagaacccatcattaatttttatgaccctttggtattcccatccgatgagtttgacgcttctatatcgcaggtcaacgagaaaatcaaccagagcctcgccttcattcggaagtccgatgaactgttacacaatgtgaacgcgggcaagtcaacaaccaatatcatgatcactaccattataatcgttattatcgtgattctgctaagtctcatcgccgtcggcctgcttttgtactgcaaagcacgctctacaccggtgaccctgagcaaggaccagctctccgggataaacaatatcgctttctcaaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5483 - RNA, 1963 nt, synthetic construct
  misc_feature 1..1963: note = mRNA product Design d-4 comprising derived and/or modified sequence from HRSV(A2)__F_DSCav1_mut5 (opt4)
  source 1..1963: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5484 - RNA, 1963 nt, synthetic construct
  misc_feature 1..1963: note = mRNA product Design d-4 comprising derived and/or modified sequence from HRSV(A2)__F_DSCav1_mut5 (opt5)
  source 1..1963: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcggatgcggcgtttctgtgctgacatttaaggtccttgacctgaagaactacattgataaacaactcctgcctatcctgaataagcagtcctgtagcatttctaacatcgagaccgtgattgagttccagcagaaaaataaccggctcctggaaatcacgcgcgagttttccgtgaatgccggcgtcacaaccccggttagcacatatatgcttaccaactccgaactgctctctctgatcaatgacatgcccattaccaacgatcaaaagaaacttatgagcaacaatgtgcagatcgtgagacagcagtcctacagcattatgtgcatcattaaggaggaagtcctggcttatgtggttcaactccctctgtacggggtgatcgacacaccctgttggaaactgcatacgtctcctctctgcaccacaaacaccaaggagggatccaatatctgtctgacacggaccgatcgcggctggtactgcgacaacgccgggagcgtctctttctttccccaggcggaaacgtgtaaggtgcagagcaatagagttttctgcgatacaatgaactccagaaccctgccttctgaggtgaatctctgcaacgtcgacatttttaatccgaaatatgattgtaagatcatgaccagcaaaacagacgtgtccagctctgtcattacctccctgggagccatcgtgagctgctacggcaagacaaaatgtacggcttctaacaagtgccgggggattatcaagaccttctccaatggatgtgattatgttagcaacaaaggcgtggacacagtctccgtgggcaataccctttactatgttaacaagcaagaggggaaatctctgtacgtgaagggagaacccatcattaatttttatgaccctctcgtcttccccagcgatgagtttgacgcctccatctctcaggtgaacgagaaaattaaccagagcctggctttcatccgcaagtccgatgaactgctccacaatgtgaacgccggcaagagcacaaccaatattatgatcacgaccattatcatcgttattatcgtcattctgctttctctgatcgccgtggggctcctgctgtactgcaaagctagatccacacctgtgacccttagcaaggaccagctctctggaattaacaatatcgcgttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5485 - RNA, 1963 nt, synthetic construct
  misc_feature 1..1963: note = mRNA product Design d-4 comprising derived and/or modified sequence from HRSV(A2)__F_DSCav1_mut5 (opt6)
  source 1..1963: mol_type = other RNA
gggagagtcccgcagtcggcgtccagcggctctgcttgttcgtgtgtgtgtcgttgcaggccttattcaagcttaccatggaactattaatacttaaagccaacgcaataacaacaattctcactgctgtcaccttctgcttcgcctcaggccaaaacataacggaagaattttaccaatcaacatgctctgcagtatccaaaggctacctatctgctctaagaacaggttggtatacatcagtaataaccatagaactatcaaacataaaagaaaataaatgcaacggaacagacgcaaaagttaaactcataaaacaagaactagacaaatataaaaacgcagttaccgaactacaactacttatgcaatccactcccgccactggatcaggatcagcaatagcatcaggagtcgcagtatgtaaagtcttacacctcgaaggcgaagtcaataaaatcaaatccgcattactatccacaaacaaagcagtcgtatccctaagcggatgcggagtatcagtactaacatttaaagtactagacctaaaaaattacatcgataaacaactattacctatattaaacaaacaatcctgctccatttcaaatatcgaaaccgtaatagaatttcaacaaaaaaacaacagattactagaaataacaagagaattttccgtaaatgctggcgtaacaacaccagtatccacatacatgctcacaaactccgaactactatcactaataaatgacatgcccataacaaacgatcaaaaaaaactaatgtcaaataatgtacaaatagtaagacaacaaagctactccatcatgtgtataataaaagaagaagtactagcatacgtagttcaactaccactttacggcgtaatcgacaccccttgctggaaactacacacctcccctctatgcaccacaaacacaaaagaaggttccaacatatgccttaccagaacagacagaggctggtattgcgacaacgcaggatcagtttcattttttccacaagctgaaacatgcaaagtacaatcaaacagagtcttctgcgacacaatgaactcaagaactctaccctcagaagtaaacctatgtaacgtagacattttcaaccccaaatacgactgcaaaattatgacatcaaaaacagacgtttcatcatcagttatcacctcattaggagcaatagtaagctgctacggaaaaacaaaatgcaccgcctcaaataaatgcagaggaataataaaaactttctccaacggatgcgactacgtttcaaacaaaggtgtagacactgtatcagtaggaaacacactatattacgtaaataaacaagaaggaaaatcactttatgtcaaaggagaaccaataatcaatttctacgacccattagtattcccatcagacgaatttgatgcttcaatatcacaagtaaacgaaaaaataaatcaatcactcgcatttatacgaaaatcagacgaactactacacaatgtaaacgcaggcaaatcaacaacaaacataatgataacaacaataatcattgtaataatagtaatacttctatctctaatagcagtaggattactcctctactgcaaagcaagatcaacccctgtaacactatcaaaagaccaactttcaggtataaataatatagctttttccaattaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5486 - RNA, 1963 nt, synthetic construct
  misc_feature 1..1963: note = mRNA product Design d-4 comprising derived and/or modified sequence from HRSV(A2)__F_DSCav1_mut5 (opt11)
  source 1..1963: mol_type = other RNA
gggagagtcccgcagtcggcgtccagcggctctgcttgttcgtgtgtgtgtcgttgcaggccttattcaagcttaccatggagctcctaatcctcaaagccaacgcgatcactacaatcctcacagccgtcaccttctgcttcgcctccggccaaaacatcaccgaggagttctaccaatcaacctgctccgccgtatcaaaaggatacctaagcgccctacggaccggctggtacacatctgtcatcaccatcgaactatcaaacatcaaagaaaacaaatgcaacggaaccgacgcaaaagtcaaactgattaaacaagaactagacaaatacaaaaacgcagtcaccgaactgcaattactcatgcaaagcacaccggccaccggctcaggcagcgccatcgcctccggcgtcgccgtctgcaaagttctccacctcgagggcgaagtcaacaaaataaaatctgccctcctctccaccaacaaagccgtcgtctccctcagcggctgcggagtctccgtcctcaccttcaaagttctcgatctcaagaactatattgacaaacaacttctacccatactcaacaaacaaagctgcagcatatccaacatcgaaaccgtcatcgagttccaacaaaagaacaaccgcctcctcgaaataacccgcgagttcagcgttaacgccggagtcactacccctgtctccacctacatgctcaccaactccgaactcctatcactaatcaacgacatgcccataaccaacgaccagaagaaactcatgtccaacaacgtccaaattgtccgacaacaaagctactccataatgtgcataataaaagaggaagtcctcgcctacgtcgtacaactgcccctttatggcgtaatcgacacaccctgctggaaactccacacgtcacccctctgcaccaccaacacaaaagaaggctcgaacatctgcctaacacggactgaccgcggctggtactgcgacaacgccggctccgtcagcttcttcccacaagccgaaacctgcaaagtacaatccaaccgagtattctgcgacaccatgaactccagaaccctcccctcagaggtcaacctgtgcaacgtagacatcttcaaccccaaatacgactgcaaaataatgacctcaaaaacagacgtctcctcttccgtaatcaccagcctcggagccatcgtcagctgctacggcaaaaccaaatgcaccgcctcaaacaaatgccgcggcatcatcaaaacattctcaaacggctgcgactacgtctccaacaaaggcgtcgacacagtaagcgtaggcaacacactgtactacgtcaacaaacaagagggaaaatcactctacgtcaaaggagaacccataatcaacttctacgaccccctcgttttccccagcgacgagttcgacgccagcatatcccaagtcaacgagaaaattaaccaatccctagcattcatccgaaaatctgacgaactgctccacaacgtcaacgcgggaaaatcaacaaccaacataatgataaccacaatcataatagtcatcatcgtaatcctcctcagcctaatcgctgtcggcctcctcctctactgcaaagcccgttccaccccagtcacactttccaaggaccaactaagcggaataaacaacatcgcgttctcaaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5487 - RNA, 2060 nt, synthetic construct
  misc_feature 1..2060: note = mRNA product Design d-5 comprising derived and/or modified sequence from HRSV(A2)__F_DSCav1_mut5 (opt1)
  source 1..2060: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5488 - RNA, 2060 nt, synthetic construct
  misc_feature 1..2060: note = mRNA product Design d-5 comprising derived and/or modified sequence from HRSV(A2)__F_DSCav1_mut5 (opt1)
  source 1..2060: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcgggtgcggcgtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggggtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggcgtgatcgacacgccgtgctggaagctgcacaccagccccctctgcaccaccaacacgaaggaggggtccaacatctgcctgacccgcaccgaccggggctggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggggccatcgtgtcctgctacggcaagaccaagtgcaccgccagcaacaagtgccgggggatcatcaagaccttctccaacggctgcgactacgtgagcaacaagggcgtcgacacggtgagcgtggggaacaccctctactacgtcaacaagcaggagggcaagtccctgtacgtgaagggggagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccggcaagtccaccaccaacatcatgatcaccacgatcatcatcgtgatcatcgtcatcctcctgagcctgatcgccgtggggctcctgctgtactgcaaggcccggtccaccccggtgaccctgagcaaggaccagctctccggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5489 - RNA, 2060 nt, synthetic construct
  misc_feature 1..2060: note = mRNA product Design d-5 comprising derived and/or modified sequence from HRSV(A2)__F_DSCav1_mut5 (opt2)
  source 1..2060: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5490 - RNA, 2060 nt, synthetic construct
  misc_feature 1..2060: note = mRNA product Design d-5 comprising derived and/or modified sequence from HRSV(A2)__F_DSCav1_mut5 (opt3)
  source 1..2060: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcggttgcggggtgtccgtattaacttttaaggttctggaccttaagaactacattgataaacaattgctgcctatcctaaataagcagtcatgtagtattagcaacatcgagaccgtgatagagttccagcagaaaaataacaggctcctggaaattacacgggagttttctgtcaatgcgggagtgactaccccagtgtccacatatatgcttaccaactcagaactgttgagcctcatcaatgacatgccgattacgaacgatcaaaagaaactgatgagtaacaatgtccagatcgttcgccagcagtcttactccatcatgtgcattataaaggaggaagtgttagcatatgtagtgcaactgcccctctacggcgtcatcgacactccttgttggaaacttcatacaagcccactgtgcaccactaacacaaaggagggctcgaatatttgtttgacccgaacggatcgtgggtggtactgcgacaacgccggatctgtgtccttctttccccaggctgaaacctgtaaggttcagtcaaatagagtgttctgcgatacaatgaacagtagaactctgcctagcgaggtcaatctctgcaacgtggacatctttaatccaaaatatgattgtaagataatgacctccaaaacagacgtatctagctcagttattaccagtctgggtgccatcgtgtcctgctacggcaagactaaatgtacagcaagcaacaagtgcagggggatcattaagaccttctctaatggatgtgattatgtctcaaacaaaggcgtggacactgtcagtgtgggtaatacgctttactatgttaacaagcaagaggggaaaagcctgtacgtgaagggagaacccatcattaatttttatgaccctttggtattcccatccgatgagtttgacgcttctatatcgcaggtcaacgagaaaatcaaccagagcctcgccttcattcggaagtccgatgaactgttacacaatgtgaacgcgggcaagtcaacaaccaatatcatgatcactaccattataatcgttattatcgtgattctgctaagtctcatcgccgtcggcctgcttttgtactgcaaagcacgctctacaccggtgaccctgagcaaggaccagctctccgggataaacaatatcgctttctcaaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5491 - RNA, 2060 nt, synthetic construct
  misc_feature 1..2060: note = mRNA product Design d-5 comprising derived and/or modified sequence from HRSV(A2)__F_DSCav1_mut5 (opt4)
  source 1..2060: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5492 - RNA, 2060 nt, synthetic construct
  misc_feature 1..2060: note = mRNA product Design d-5 comprising derived and/or modified sequence from HRSV(A2)__F_DSCav1_mut5 (opt5)
  source 1..2060: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcggatgcggcgtttctgtgctgacatttaaggtccttgacctgaagaactacattgataaacaactcctgcctatcctgaataagcagtcctgtagcatttctaacatcgagaccgtgattgagttccagcagaaaaataaccggctcctggaaatcacgcgcgagttttccgtgaatgccggcgtcacaaccccggttagcacatatatgcttaccaactccgaactgctctctctgatcaatgacatgcccattaccaacgatcaaaagaaacttatgagcaacaatgtgcagatcgtgagacagcagtcctacagcattatgtgcatcattaaggaggaagtcctggcttatgtggttcaactccctctgtacggggtgatcgacacaccctgttggaaactgcatacgtctcctctctgcaccacaaacaccaaggagggatccaatatctgtctgacacggaccgatcgcggctggtactgcgacaacgccgggagcgtctctttctttccccaggcggaaacgtgtaaggtgcagagcaatagagttttctgcgatacaatgaactccagaaccctgccttctgaggtgaatctctgcaacgtcgacatttttaatccgaaatatgattgtaagatcatgaccagcaaaacagacgtgtccagctctgtcattacctccctgggagccatcgtgagctgctacggcaagacaaaatgtacggcttctaacaagtgccgggggattatcaagaccttctccaatggatgtgattatgttagcaacaaaggcgtggacacagtctccgtgggcaataccctttactatgttaacaagcaagaggggaaatctctgtacgtgaagggagaacccatcattaatttttatgaccctctcgtcttccccagcgatgagtttgacgcctccatctctcaggtgaacgagaaaattaaccagagcctggctttcatccgcaagtccgatgaactgctccacaatgtgaacgccggcaagagcacaaccaatattatgatcacgaccattatcatcgttattatcgtcattctgctttctctgatcgccgtggggctcctgctgtactgcaaagctagatccacacctgtgacccttagcaaggaccagctctctggaattaacaatatcgcgttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5493 - RNA, 2060 nt, synthetic construct
  misc_feature 1..2060: note = mRNA product Design d-5 comprising derived and/or modified sequence from HRSV(A2)__F_DSCav1_mut5 (opt6)
  source 1..2060: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactattaatacttaaagccaacgcaataacaacaattctcactgctgtcaccttctgcttcgcctcaggccaaaacataacggaagaattttaccaatcaacatgctctgcagtatccaaaggctacctatctgctctaagaacaggttggtatacatcagtaataaccatagaactatcaaacataaaagaaaataaatgcaacggaacagacgcaaaagttaaactcataaaacaagaactagacaaatataaaaacgcagttaccgaactacaactacttatgcaatccactcccgccactggatcaggatcagcaatagcatcaggagtcgcagtatgtaaagtcttacacctcgaaggcgaagtcaataaaatcaaatccgcattactatccacaaacaaagcagtcgtatccctaagcggatgcggagtatcagtactaacatttaaagtactagacctaaaaaattacatcgataaacaactattacctatattaaacaaacaatcctgctccatttcaaatatcgaaaccgtaatagaatttcaacaaaaaaacaacagattactagaaataacaagagaattttccgtaaatgctggcgtaacaacaccagtatccacatacatgctcacaaactccgaactactatcactaataaatgacatgcccataacaaacgatcaaaaaaaactaatgtcaaataatgtacaaatagtaagacaacaaagctactccatcatgtgtataataaaagaagaagtactagcatacgtagttcaactaccactttacggcgtaatcgacaccccttgctggaaactacacacctcccctctatgcaccacaaacacaaaagaaggttccaacatatgccttaccagaacagacagaggctggtattgcgacaacgcaggatcagtttcattttttccacaagctgaaacatgcaaagtacaatcaaacagagtcttctgcgacacaatgaactcaagaactctaccctcagaagtaaacctatgtaacgtagacattttcaaccccaaatacgactgcaaaattatgacatcaaaaacagacgtttcatcatcagttatcacctcattaggagcaatagtaagctgctacggaaaaacaaaatgcaccgcctcaaataaatgcagaggaataataaaaactttctccaacggatgcgactacgtttcaaacaaaggtgtagacactgtatcagtaggaaacacactatattacgtaaataaacaagaaggaaaatcactttatgtcaaaggagaaccaataatcaatttctacgacccattagtattcccatcagacgaatttgatgcttcaatatcacaagtaaacgaaaaaataaatcaatcactcgcatttatacgaaaatcagacgaactactacacaatgtaaacgcaggcaaatcaacaacaaacataatgataacaacaataatcattgtaataatagtaatacttctatctctaatagcagtaggattactcctctactgcaaagcaagatcaacccctgtaacactatcaaaagaccaactttcaggtataaataatatagctttttccaattaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5494 - RNA, 2060 nt, synthetic construct
  misc_feature 1..2060: note = mRNA product Design d-5 comprising derived and/or modified sequence from HRSV(A2)__F_DSCav1_mut5 (opt11)
  source 1..2060: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctaatcctcaaagccaacgcgatcactacaatcctcacagccgtcaccttctgcttcgcctccggccaaaacatcaccgaggagttctaccaatcaacctgctccgccgtatcaaaaggatacctaagcgccctacggaccggctggtacacatctgtcatcaccatcgaactatcaaacatcaaagaaaacaaatgcaacggaaccgacgcaaaagtcaaactgattaaacaagaactagacaaatacaaaaacgcagtcaccgaactgcaattactcatgcaaagcacaccggccaccggctcaggcagcgccatcgcctccggcgtcgccgtctgcaaagttctccacctcgagggcgaagtcaacaaaataaaatctgccctcctctccaccaacaaagccgtcgtctccctcagcggctgcggagtctccgtcctcaccttcaaagttctcgatctcaagaactatattgacaaacaacttctacccatactcaacaaacaaagctgcagcatatccaacatcgaaaccgtcatcgagttccaacaaaagaacaaccgcctcctcgaaataacccgcgagttcagcgttaacgccggagtcactacccctgtctccacctacatgctcaccaactccgaactcctatcactaatcaacgacatgcccataaccaacgaccagaagaaactcatgtccaacaacgtccaaattgtccgacaacaaagctactccataatgtgcataataaaagaggaagtcctcgcctacgtcgtacaactgcccctttatggcgtaatcgacacaccctgctggaaactccacacgtcacccctctgcaccaccaacacaaaagaaggctcgaacatctgcctaacacggactgaccgcggctggtactgcgacaacgccggctccgtcagcttcttcccacaagccgaaacctgcaaagtacaatccaaccgagtattctgcgacaccatgaactccagaaccctcccctcagaggtcaacctgtgcaacgtagacatcttcaaccccaaatacgactgcaaaataatgacctcaaaaacagacgtctcctcttccgtaatcaccagcctcggagccatcgtcagctgctacggcaaaaccaaatgcaccgcctcaaacaaatgccgcggcatcatcaaaacattctcaaacggctgcgactacgtctccaacaaaggcgtcgacacagtaagcgtaggcaacacactgtactacgtcaacaaacaagagggaaaatcactctacgtcaaaggagaacccataatcaacttctacgaccccctcgttttccccagcgacgagttcgacgccagcatatcccaagtcaacgagaaaattaaccaatccctagcattcatccgaaaatctgacgaactgctccacaacgtcaacgcgggaaaatcaacaaccaacataatgataaccacaatcataatagtcatcatcgtaatcctcctcagcctaatcgctgtcggcctcctcctctactgcaaagcccgttccaccccagtcacactttccaaggaccaactaagcggaataaacaacatcgcgttctcaaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5495 - RNA, 1940 nt, synthetic construct
  misc_feature 1..1940: note = mRNA product Design e-1 comprising derived and/or modified sequence from HRSV(A2)__F_DSCav1_mut5 (opt1)
  source 1..1940: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5496 - RNA, 1940 nt, synthetic construct
  misc_feature 1..1940: note = mRNA product Design e-1 comprising derived and/or modified sequence from HRSV(A2)__F_DSCav1_mut5 (opt1)
  source 1..1940: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcgggtgcggcgtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggggtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggcgtgatcgacacgccgtgctggaagctgcacaccagccccctctgcaccaccaacacgaaggaggggtccaacatctgcctgacccgcaccgaccggggctggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggggccatcgtgtcctgctacggcaagaccaagtgcaccgccagcaacaagtgccgggggatcatcaagaccttctccaacggctgcgactacgtgagcaacaagggcgtcgacacggtgagcgtggggaacaccctctactacgtcaacaagcaggagggcaagtccctgtacgtgaagggggagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccggcaagtccaccaccaacatcatgatcaccacgatcatcatcgtgatcatcgtcatcctcctgagcctgatcgccgtggggctcctgctgtactgcaaggcccggtccaccccggtgaccctgagcaaggaccagctctccggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5497 - RNA, 1940 nt, synthetic construct
  misc_feature 1..1940: note = mRNA product Design e-1 comprising derived and/or modified sequence from HRSV(A2)__F_DSCav1_mut5 (opt2)
  source 1..1940: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5498 - RNA, 1940 nt, synthetic construct
  misc_feature 1..1940: note = mRNA product Design e-1 comprising derived and/or modified sequence from HRSV(A2)__F_DSCav1_mut5 (opt3)
  source 1..1940: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcggttgcggggtgtccgtattaacttttaaggttctggaccttaagaactacattgataaacaattgctgcctatcctaaataagcagtcatgtagtattagcaacatcgagaccgtgatagagttccagcagaaaaataacaggctcctggaaattacacgggagttttctgtcaatgcgggagtgactaccccagtgtccacatatatgcttaccaactcagaactgttgagcctcatcaatgacatgccgattacgaacgatcaaaagaaactgatgagtaacaatgtccagatcgttcgccagcagtcttactccatcatgtgcattataaaggaggaagtgttagcatatgtagtgcaactgcccctctacggcgtcatcgacactccttgttggaaacttcatacaagcccactgtgcaccactaacacaaaggagggctcgaatatttgtttgacccgaacggatcgtgggtggtactgcgacaacgccggatctgtgtccttctttccccaggctgaaacctgtaaggttcagtcaaatagagtgttctgcgatacaatgaacagtagaactctgcctagcgaggtcaatctctgcaacgtggacatctttaatccaaaatatgattgtaagataatgacctccaaaacagacgtatctagctcagttattaccagtctgggtgccatcgtgtcctgctacggcaagactaaatgtacagcaagcaacaagtgcagggggatcattaagaccttctctaatggatgtgattatgtctcaaacaaaggcgtggacactgtcagtgtgggtaatacgctttactatgttaacaagcaagaggggaaaagcctgtacgtgaagggagaacccatcattaatttttatgaccctttggtattcccatccgatgagtttgacgcttctatatcgcaggtcaacgagaaaatcaaccagagcctcgccttcattcggaagtccgatgaactgttacacaatgtgaacgcgggcaagtcaacaaccaatatcatgatcactaccattataatcgttattatcgtgattctgctaagtctcatcgccgtcggcctgcttttgtactgcaaagcacgctctacaccggtgaccctgagcaaggaccagctctccgggataaacaatatcgctttctcaaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5499 - RNA, 1940 nt, synthetic construct
  misc_feature 1..1940: note = mRNA product Design e-1 comprising derived and/or modified sequence from HRSV(A2)__F_DSCav1_mut5 (opt4)
  source 1..1940: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5500 - RNA, 1940 nt, synthetic construct
  misc_feature 1..1940: note = mRNA product Design e-1 comprising derived and/or modified sequence from HRSV(A2)__F_DSCav1_mut5 (opt5)
  source 1..1940: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcggatgcggcgtttctgtgctgacatttaaggtccttgacctgaagaactacattgataaacaactcctgcctatcctgaataagcagtcctgtagcatttctaacatcgagaccgtgattgagttccagcagaaaaataaccggctcctggaaatcacgcgcgagttttccgtgaatgccggcgtcacaaccccggttagcacatatatgcttaccaactccgaactgctctctctgatcaatgacatgcccattaccaacgatcaaaagaaacttatgagcaacaatgtgcagatcgtgagacagcagtcctacagcattatgtgcatcattaaggaggaagtcctggcttatgtggttcaactccctctgtacggggtgatcgacacaccctgttggaaactgcatacgtctcctctctgcaccacaaacaccaaggagggatccaatatctgtctgacacggaccgatcgcggctggtactgcgacaacgccgggagcgtctctttctttccccaggcggaaacgtgtaaggtgcagagcaatagagttttctgcgatacaatgaactccagaaccctgccttctgaggtgaatctctgcaacgtcgacatttttaatccgaaatatgattgtaagatcatgaccagcaaaacagacgtgtccagctctgtcattacctccctgggagccatcgtgagctgctacggcaagacaaaatgtacggcttctaacaagtgccgggggattatcaagaccttctccaatggatgtgattatgttagcaacaaaggcgtggacacagtctccgtgggcaataccctttactatgttaacaagcaagaggggaaatctctgtacgtgaagggagaacccatcattaatttttatgaccctctcgtcttccccagcgatgagtttgacgcctccatctctcaggtgaacgagaaaattaaccagagcctggctttcatccgcaagtccgatgaactgctccacaatgtgaacgccggcaagagcacaaccaatattatgatcacgaccattatcatcgttattatcgtcattctgctttctctgatcgccgtggggctcctgctgtactgcaaagctagatccacacctgtgacccttagcaaggaccagctctctggaattaacaatatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5501 - RNA, 1940 nt, synthetic construct
  misc_feature 1..1940: note = mRNA product Design e-1 comprising derived and/or modified sequence from HRSV(A2)__F_DSCav1_mut5 (opt6)
  source 1..1940: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggaactattaatacttaaagccaacgcaataacaacaattctcactgctgtcaccttctgcttcgcctcaggccaaaacataacggaagaattttaccaatcaacatgctctgcagtatccaaaggctacctatctgctctaagaacaggttggtatacatcagtaataaccatagaactatcaaacataaaagaaaataaatgcaacggaacagacgcaaaagttaaactcataaaacaagaactagacaaatataaaaacgcagttaccgaactacaactacttatgcaatccactcccgccactggatcaggatcagcaatagcatcaggagtcgcagtatgtaaagtcttacacctcgaaggcgaagtcaataaaatcaaatccgcattactatccacaaacaaagcagtcgtatccctaagcggatgcggagtatcagtactaacatttaaagtactagacctaaaaaattacatcgataaacaactattacctatattaaacaaacaatcctgctccatttcaaatatcgaaaccgtaatagaatttcaacaaaaaaacaacagattactagaaataacaagagaattttccgtaaatgctggcgtaacaacaccagtatccacatacatgctcacaaactccgaactactatcactaataaatgacatgcccataacaaacgatcaaaaaaaactaatgtcaaataatgtacaaatagtaagacaacaaagctactccatcatgtgtataataaaagaagaagtactagcatacgtagttcaactaccactttacggcgtaatcgacaccccttgctggaaactacacacctcccctctatgcaccacaaacacaaaagaaggttccaacatatgccttaccagaacagacagaggctggtattgcgacaacgcaggatcagtttcattttttccacaagctgaaacatgcaaagtacaatcaaacagagtcttctgcgacacaatgaactcaagaactctaccctcagaagtaaacctatgtaacgtagacattttcaaccccaaatacgactgcaaaattatgacatcaaaaacagacgtttcatcatcagttatcacctcattaggagcaatagtaagctgctacggaaaaacaaaatgcaccgcctcaaataaatgcagaggaataataaaaactttctccaacggatgcgactacgtttcaaacaaaggtgtagacactgtatcagtaggaaacacactatattacgtaaataaacaagaaggaaaatcactttatgtcaaaggagaaccaataatcaatttctacgacccattagtattcccatcagacgaatttgatgcttcaatatcacaagtaaacgaaaaaataaatcaatcactcgcatttatacgaaaatcagacgaactactacacaatgtaaacgcaggcaaatcaacaacaaacataatgataacaacaataatcattgtaataatagtaatacttctatctctaatagcagtaggattactcctctactgcaaagcaagatcaacccctgtaacactatcaaaagaccaactttcaggtataaataatatagctttttccaattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5502 - RNA, 1940 nt, synthetic construct
  misc_feature 1..1940: note = mRNA product Design e-1 comprising derived and/or modified sequence from HRSV(A2)__F_DSCav1_mut5 (opt11)
  source 1..1940: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctcctaatcctcaaagccaacgcgatcactacaatcctcacagccgtcaccttctgcttcgcctccggccaaaacatcaccgaggagttctaccaatcaacctgctccgccgtatcaaaaggatacctaagcgccctacggaccggctggtacacatctgtcatcaccatcgaactatcaaacatcaaagaaaacaaatgcaacggaaccgacgcaaaagtcaaactgattaaacaagaactagacaaatacaaaaacgcagtcaccgaactgcaattactcatgcaaagcacaccggccaccggctcaggcagcgccatcgcctccggcgtcgccgtctgcaaagttctccacctcgagggcgaagtcaacaaaataaaatctgccctcctctccaccaacaaagccgtcgtctccctcagcggctgcggagtctccgtcctcaccttcaaagttctcgatctcaagaactatattgacaaacaacttctacccatactcaacaaacaaagctgcagcatatccaacatcgaaaccgtcatcgagttccaacaaaagaacaaccgcctcctcgaaataacccgcgagttcagcgttaacgccggagtcactacccctgtctccacctacatgctcaccaactccgaactcctatcactaatcaacgacatgcccataaccaacgaccagaagaaactcatgtccaacaacgtccaaattgtccgacaacaaagctactccataatgtgcataataaaagaggaagtcctcgcctacgtcgtacaactgcccctttatggcgtaatcgacacaccctgctggaaactccacacgtcacccctctgcaccaccaacacaaaagaaggctcgaacatctgcctaacacggactgaccgcggctggtactgcgacaacgccggctccgtcagcttcttcccacaagccgaaacctgcaaagtacaatccaaccgagtattctgcgacaccatgaactccagaaccctcccctcagaggtcaacctgtgcaacgtagacatcttcaaccccaaatacgactgcaaaataatgacctcaaaaacagacgtctcctcttccgtaatcaccagcctcggagccatcgtcagctgctacggcaaaaccaaatgcaccgcctcaaacaaatgccgcggcatcatcaaaacattctcaaacggctgcgactacgtctccaacaaaggcgtcgacacagtaagcgtaggcaacacactgtactacgtcaacaaacaagagggaaaatcactctacgtcaaaggagaacccataatcaacttctacgaccccctcgttttccccagcgacgagttcgacgccagcatatcccaagtcaacgagaaaattaaccaatccctagcattcatccgaaaatctgacgaactgctccacaacgtcaacgcgggaaaatcaacaaccaacataatgataaccacaatcataatagtcatcatcgtaatcctcctcagcctaatcgctgtcggcctcctcctctactgcaaagcccgttccaccccagtcacactttccaaggaccaactaagcggaataaacaacatcgcgttctcaaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5503 - RNA, 1922 nt, synthetic construct
  misc_feature 1..1922: note = mRNA product Design e-2 comprising derived and/or modified sequence from HRSV(A2)__F_DSCav1_mut5 (opt1)
  source 1..1922: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5504 - RNA, 1922 nt, synthetic construct
  misc_feature 1..1922: note = mRNA product Design e-2 comprising derived and/or modified sequence from HRSV(A2)__F_DSCav1_mut5 (opt1)
  source 1..1922: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcgggtgcggcgtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggggtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggcgtgatcgacacgccgtgctggaagctgcacaccagccccctctgcaccaccaacacgaaggaggggtccaacatctgcctgacccgcaccgaccggggctggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggggccatcgtgtcctgctacggcaagaccaagtgcaccgccagcaacaagtgccgggggatcatcaagaccttctccaacggctgcgactacgtgagcaacaagggcgtcgacacggtgagcgtggggaacaccctctactacgtcaacaagcaggagggcaagtccctgtacgtgaagggggagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccggcaagtccaccaccaacatcatgatcaccacgatcatcatcgtgatcatcgtcatcctcctgagcctgatcgccgtggggctcctgctgtactgcaaggcccggtccaccccggtgaccctgagcaaggaccagctctccggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5505 - RNA, 1922 nt, synthetic construct
  misc_feature 1..1922: note = mRNA product Design e-2 comprising derived and/or modified sequence from HRSV(A2)__F_DSCav1_mut5 (opt2)
  source 1..1922: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5506 - RNA, 1922 nt, synthetic construct
  misc_feature 1..1922: note = mRNA product Design e-2 comprising derived and/or modified sequence from HRSV(A2)__F_DSCav1_mut5 (opt3)
  source 1..1922: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcggttgcggggtgtccgtattaacttttaaggttctggaccttaagaactacattgataaacaattgctgcctatcctaaataagcagtcatgtagtattagcaacatcgagaccgtgatagagttccagcagaaaaataacaggctcctggaaattacacgggagttttctgtcaatgcgggagtgactaccccagtgtccacatatatgcttaccaactcagaactgttgagcctcatcaatgacatgccgattacgaacgatcaaaagaaactgatgagtaacaatgtccagatcgttcgccagcagtcttactccatcatgtgcattataaaggaggaagtgttagcatatgtagtgcaactgcccctctacggcgtcatcgacactccttgttggaaacttcatacaagcccactgtgcaccactaacacaaaggagggctcgaatatttgtttgacccgaacggatcgtgggtggtactgcgacaacgccggatctgtgtccttctttccccaggctgaaacctgtaaggttcagtcaaatagagtgttctgcgatacaatgaacagtagaactctgcctagcgaggtcaatctctgcaacgtggacatctttaatccaaaatatgattgtaagataatgacctccaaaacagacgtatctagctcagttattaccagtctgggtgccatcgtgtcctgctacggcaagactaaatgtacagcaagcaacaagtgcagggggatcattaagaccttctctaatggatgtgattatgtctcaaacaaaggcgtggacactgtcagtgtgggtaatacgctttactatgttaacaagcaagaggggaaaagcctgtacgtgaagggagaacccatcattaatttttatgaccctttggtattcccatccgatgagtttgacgcttctatatcgcaggtcaacgagaaaatcaaccagagcctcgccttcattcggaagtccgatgaactgttacacaatgtgaacgcgggcaagtcaacaaccaatatcatgatcactaccattataatcgttattatcgtgattctgctaagtctcatcgccgtcggcctgcttttgtactgcaaagcacgctctacaccggtgaccctgagcaaggaccagctctccgggataaacaatatcgctttctcaaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5507 - RNA, 1922 nt, synthetic construct
  misc_feature 1..1922: note = mRNA product Design e-2 comprising derived and/or modified sequence from HRSV(A2)__F_DSCav1_mut5 (opt4)
  source 1..1922: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5508 - RNA, 1922 nt, synthetic construct
  misc_feature 1..1922: note = mRNA product Design e-2 comprising derived and/or modified sequence from HRSV(A2)__F_DSCav1_mut5 (opt5)
  source 1..1922: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcggatgcggcgtttctgtgctgacatttaaggtccttgacctgaagaactacattgataaacaactcctgcctatcctgaataagcagtcctgtagcatttctaacatcgagaccgtgattgagttccagcagaaaaataaccggctcctggaaatcacgcgcgagttttccgtgaatgccggcgtcacaaccccggttagcacatatatgcttaccaactccgaactgctctctctgatcaatgacatgcccattaccaacgatcaaaagaaacttatgagcaacaatgtgcagatcgtgagacagcagtcctacagcattatgtgcatcattaaggaggaagtcctggcttatgtggttcaactccctctgtacggggtgatcgacacaccctgttggaaactgcatacgtctcctctctgcaccacaaacaccaaggagggatccaatatctgtctgacacggaccgatcgcggctggtactgcgacaacgccgggagcgtctctttctttccccaggcggaaacgtgtaaggtgcagagcaatagagttttctgcgatacaatgaactccagaaccctgccttctgaggtgaatctctgcaacgtcgacatttttaatccgaaatatgattgtaagatcatgaccagcaaaacagacgtgtccagctctgtcattacctccctgggagccatcgtgagctgctacggcaagacaaaatgtacggcttctaacaagtgccgggggattatcaagaccttctccaatggatgtgattatgttagcaacaaaggcgtggacacagtctccgtgggcaataccctttactatgttaacaagcaagaggggaaatctctgtacgtgaagggagaacccatcattaatttttatgaccctctcgtcttccccagcgatgagtttgacgcctccatctctcaggtgaacgagaaaattaaccagagcctggctttcatccgcaagtccgatgaactgctccacaatgtgaacgccggcaagagcacaaccaatattatgatcacgaccattatcatcgttattatcgtcattctgctttctctgatcgccgtggggctcctgctgtactgcaaagctagatccacacctgtgacccttagcaaggaccagctctctggaattaacaatatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5509 - RNA, 1922 nt, synthetic construct
  misc_feature 1..1922: note = mRNA product Design e-2 comprising derived and/or modified sequence from HRSV(A2)__F_DSCav1_mut5 (opt6)
  source 1..1922: mol_type = other RNA
gggagacccgtgacccggaagttgtacggctacgcgactttccctcccacaaaccctcgcgcccttcctttcctacttgggcccggcagaaagcttaccatggaactattaatacttaaagccaacgcaataacaacaattctcactgctgtcaccttctgcttcgcctcaggccaaaacataacggaagaattttaccaatcaacatgctctgcagtatccaaaggctacctatctgctctaagaacaggttggtatacatcagtaataaccatagaactatcaaacataaaagaaaataaatgcaacggaacagacgcaaaagttaaactcataaaacaagaactagacaaatataaaaacgcagttaccgaactacaactacttatgcaatccactcccgccactggatcaggatcagcaatagcatcaggagtcgcagtatgtaaagtcttacacctcgaaggcgaagtcaataaaatcaaatccgcattactatccacaaacaaagcagtcgtatccctaagcggatgcggagtatcagtactaacatttaaagtactagacctaaaaaattacatcgataaacaactattacctatattaaacaaacaatcctgctccatttcaaatatcgaaaccgtaatagaatttcaacaaaaaaacaacagattactagaaataacaagagaattttccgtaaatgctggcgtaacaacaccagtatccacatacatgctcacaaactccgaactactatcactaataaatgacatgcccataacaaacgatcaaaaaaaactaatgtcaaataatgtacaaatagtaagacaacaaagctactccatcatgtgtataataaaagaagaagtactagcatacgtagttcaactaccactttacggcgtaatcgacaccccttgctggaaactacacacctcccctctatgcaccacaaacacaaaagaaggttccaacatatgccttaccagaacagacagaggctggtattgcgacaacgcaggatcagtttcattttttccacaagctgaaacatgcaaagtacaatcaaacagagtcttctgcgacacaatgaactcaagaactctaccctcagaagtaaacctatgtaacgtagacattttcaaccccaaatacgactgcaaaattatgacatcaaaaacagacgtttcatcatcagttatcacctcattaggagcaatagtaagctgctacggaaaaacaaaatgcaccgcctcaaataaatgcagaggaataataaaaactttctccaacggatgcgactacgtttcaaacaaaggtgtagacactgtatcagtaggaaacacactatattacgtaaataaacaagaaggaaaatcactttatgtcaaaggagaaccaataatcaatttctacgacccattagtattcccatcagacgaatttgatgcttcaatatcacaagtaaacgaaaaaataaatcaatcactcgcatttatacgaaaatcagacgaactactacacaatgtaaacgcaggcaaatcaacaacaaacataatgataacaacaataatcattgtaataatagtaatacttctatctctaatagcagtaggattactcctctactgcaaagcaagatcaacccctgtaacactatcaaaagaccaactttcaggtataaataatatagctttttccaattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5510 - RNA, 1922 nt, synthetic construct
  misc_feature 1..1922: note = mRNA product Design e-2 comprising derived and/or modified sequence from HRSV(A2)__F_DSCav1_mut5 (opt11)
  source 1..1922: mol_type = other RNA
gggagacccgtgacccggaagttgtacggctacgcgactttccctcccacaaaccctcgcgcccttcctttcctacttgggcccggcagaaagcttaccatggagctcctaatcctcaaagccaacgcgatcactacaatcctcacagccgtcaccttctgcttcgcctccggccaaaacatcaccgaggagttctaccaatcaacctgctccgccgtatcaaaaggatacctaagcgccctacggaccggctggtacacatctgtcatcaccatcgaactatcaaacatcaaagaaaacaaatgcaacggaaccgacgcaaaagtcaaactgattaaacaagaactagacaaatacaaaaacgcagtcaccgaactgcaattactcatgcaaagcacaccggccaccggctcaggcagcgccatcgcctccggcgtcgccgtctgcaaagttctccacctcgagggcgaagtcaacaaaataaaatctgccctcctctccaccaacaaagccgtcgtctccctcagcggctgcggagtctccgtcctcaccttcaaagttctcgatctcaagaactatattgacaaacaacttctacccatactcaacaaacaaagctgcagcatatccaacatcgaaaccgtcatcgagttccaacaaaagaacaaccgcctcctcgaaataacccgcgagttcagcgttaacgccggagtcactacccctgtctccacctacatgctcaccaactccgaactcctatcactaatcaacgacatgcccataaccaacgaccagaagaaactcatgtccaacaacgtccaaattgtccgacaacaaagctactccataatgtgcataataaaagaggaagtcctcgcctacgtcgtacaactgcccctttatggcgtaatcgacacaccctgctggaaactccacacgtcacccctctgcaccaccaacacaaaagaaggctcgaacatctgcctaacacggactgaccgcggctggtactgcgacaacgccggctccgtcagcttcttcccacaagccgaaacctgcaaagtacaatccaaccgagtattctgcgacaccatgaactccagaaccctcccctcagaggtcaacctgtgcaacgtagacatcttcaaccccaaatacgactgcaaaataatgacctcaaaaacagacgtctcctcttccgtaatcaccagcctcggagccatcgtcagctgctacggcaaaaccaaatgcaccgcctcaaacaaatgccgcggcatcatcaaaacattctcaaacggctgcgactacgtctccaacaaaggcgtcgacacagtaagcgtaggcaacacactgtactacgtcaacaaacaagagggaaaatcactctacgtcaaaggagaacccataatcaacttctacgaccccctcgttttccccagcgacgagttcgacgccagcatatcccaagtcaacgagaaaattaaccaatccctagcattcatccgaaaatctgacgaactgctccacaacgtcaacgcgggaaaatcaacaaccaacataatgataaccacaatcataatagtcatcatcgtaatcctcctcagcctaatcgctgtcggcctcctcctctactgcaaagcccgttccaccccagtcacactttccaaggaccaactaagcggaataaacaacatcgcgttctcaaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5511 - RNA, 1892 nt, synthetic construct
  misc_feature 1..1892: note = mRNA product Design e-3 comprising derived and/or modified sequence from HRSV(A2)__F_DSCav1_mut5 (opt1)
  source 1..1892: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5512 - RNA, 1892 nt, synthetic construct
  misc_feature 1..1892: note = mRNA product Design e-3 comprising derived and/or modified sequence from HRSV(A2)__F_DSCav1_mut5 (opt1)
  source 1..1892: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcgggtgcggcgtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggggtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggcgtgatcgacacgccgtgctggaagctgcacaccagccccctctgcaccaccaacacgaaggaggggtccaacatctgcctgacccgcaccgaccggggctggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggggccatcgtgtcctgctacggcaagaccaagtgcaccgccagcaacaagtgccgggggatcatcaagaccttctccaacggctgcgactacgtgagcaacaagggcgtcgacacggtgagcgtggggaacaccctctactacgtcaacaagcaggagggcaagtccctgtacgtgaagggggagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccggcaagtccaccaccaacatcatgatcaccacgatcatcatcgtgatcatcgtcatcctcctgagcctgatcgccgtggggctcctgctgtactgcaaggcccggtccaccccggtgaccctgagcaaggaccagctctccggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5513 - RNA, 1892 nt, synthetic construct
  misc_feature 1..1892: note = mRNA product Design e-3 comprising derived and/or modified sequence from HRSV(A2)__F_DSCav1_mut5 (opt2)
  source 1..1892: mol_type = other RNA
gggagactttcccattctgtagcagaatttggtgttgcctgtggtcttggtcccgcggagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5514 - RNA, 1892 nt, synthetic construct
  misc_feature 1..1892: note = mRNA product Design e-3 comprising derived and/or modified sequence from HRSV(A2)__F_DSCav1_mut5 (opt3)
  source 1..1892: mol_type = other RNA
gggagactttcccattctgtagcagaatttggtgttgcctgtggtcttggtcccgcggagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcggttgcggggtgtccgtattaacttttaaggttctggaccttaagaactacattgataaacaattgctgcctatcctaaataagcagtcatgtagtattagcaacatcgagaccgtgatagagttccagcagaaaaataacaggctcctggaaattacacgggagttttctgtcaatgcgggagtgactaccccagtgtccacatatatgcttaccaactcagaactgttgagcctcatcaatgacatgccgattacgaacgatcaaaagaaactgatgagtaacaatgtccagatcgttcgccagcagtcttactccatcatgtgcattataaaggaggaagtgttagcatatgtagtgcaactgcccctctacggcgtcatcgacactccttgttggaaacttcatacaagcccactgtgcaccactaacacaaaggagggctcgaatatttgtttgacccgaacggatcgtgggtggtactgcgacaacgccggatctgtgtccttctttccccaggctgaaacctgtaaggttcagtcaaatagagtgttctgcgatacaatgaacagtagaactctgcctagcgaggtcaatctctgcaacgtggacatctttaatccaaaatatgattgtaagataatgacctccaaaacagacgtatctagctcagttattaccagtctgggtgccatcgtgtcctgctacggcaagactaaatgtacagcaagcaacaagtgcagggggatcattaagaccttctctaatggatgtgattatgtctcaaacaaaggcgtggacactgtcagtgtgggtaatacgctttactatgttaacaagcaagaggggaaaagcctgtacgtgaagggagaacccatcattaatttttatgaccctttggtattcccatccgatgagtttgacgcttctatatcgcaggtcaacgagaaaatcaaccagagcctcgccttcattcggaagtccgatgaactgttacacaatgtgaacgcgggcaagtcaacaaccaatatcatgatcactaccattataatcgttattatcgtgattctgctaagtctcatcgccgtcggcctgcttttgtactgcaaagcacgctctacaccggtgaccctgagcaaggaccagctctccgggataaacaatatcgctttctcaaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5515 - RNA, 1892 nt, synthetic construct
  misc_feature 1..1892: note = mRNA product Design e-3 comprising derived and/or modified sequence from HRSV(A2)__F_DSCav1_mut5 (opt4)
  source 1..1892: mol_type = other RNA
gggagactttcccattctgtagcagaatttggtgttgcctgtggtcttggtcccgcggagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5516 - RNA, 1892 nt, synthetic construct
  misc_feature 1..1892: note = mRNA product Design e-3 comprising derived and/or modified sequence from HRSV(A2)__F_DSCav1_mut5 (opt5)
  source 1..1892: mol_type = other RNA
gggagactttcccattctgtagcagaatttggtgttgcctgtggtcttggtcccgcggagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcggatgcggcgtttctgtgctgacatttaaggtccttgacctgaagaactacattgataaacaactcctgcctatcctgaataagcagtcctgtagcatttctaacatcgagaccgtgattgagttccagcagaaaaataaccggctcctggaaatcacgcgcgagttttccgtgaatgccggcgtcacaaccccggttagcacatatatgcttaccaactccgaactgctctctctgatcaatgacatgcccattaccaacgatcaaaagaaacttatgagcaacaatgtgcagatcgtgagacagcagtcctacagcattatgtgcatcattaaggaggaagtcctggcttatgtggttcaactccctctgtacggggtgatcgacacaccctgttggaaactgcatacgtctcctctctgcaccacaaacaccaaggagggatccaatatctgtctgacacggaccgatcgcggctggtactgcgacaacgccgggagcgtctctttctttccccaggcggaaacgtgtaaggtgcagagcaatagagttttctgcgatacaatgaactccagaaccctgccttctgaggtgaatctctgcaacgtcgacatttttaatccgaaatatgattgtaagatcatgaccagcaaaacagacgtgtccagctctgtcattacctccctgggagccatcgtgagctgctacggcaagacaaaatgtacggcttctaacaagtgccgggggattatcaagaccttctccaatggatgtgattatgttagcaacaaaggcgtggacacagtctccgtgggcaataccctttactatgttaacaagcaagaggggaaatctctgtacgtgaagggagaacccatcattaatttttatgaccctctcgtcttccccagcgatgagtttgacgcctccatctctcaggtgaacgagaaaattaaccagagcctggctttcatccgcaagtccgatgaactgctccacaatgtgaacgccggcaagagcacaaccaatattatgatcacgaccattatcatcgttattatcgtcattctgctttctctgatcgccgtggggctcctgctgtactgcaaagctagatccacacctgtgacccttagcaaggaccagctctctggaattaacaatatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5517 - RNA, 1892 nt, synthetic construct
  misc_feature 1..1892: note = mRNA product Design e-3 comprising derived and/or modified sequence from HRSV(A2)__F_DSCav1_mut5 (opt6)
  source 1..1892: mol_type = other RNA
gggagactttcccattctgtagcagaatttggtgttgcctgtggtcttggtcccgcggagaagcttaccatggaactattaatacttaaagccaacgcaataacaacaattctcactgctgtcaccttctgcttcgcctcaggccaaaacataacggaagaattttaccaatcaacatgctctgcagtatccaaaggctacctatctgctctaagaacaggttggtatacatcagtaataaccatagaactatcaaacataaaagaaaataaatgcaacggaacagacgcaaaagttaaactcataaaacaagaactagacaaatataaaaacgcagttaccgaactacaactacttatgcaatccactcccgccactggatcaggatcagcaatagcatcaggagtcgcagtatgtaaagtcttacacctcgaaggcgaagtcaataaaatcaaatccgcattactatccacaaacaaagcagtcgtatccctaagcggatgcggagtatcagtactaacatttaaagtactagacctaaaaaattacatcgataaacaactattacctatattaaacaaacaatcctgctccatttcaaatatcgaaaccgtaatagaatttcaacaaaaaaacaacagattactagaaataacaagagaattttccgtaaatgctggcgtaacaacaccagtatccacatacatgctcacaaactccgaactactatcactaataaatgacatgcccataacaaacgatcaaaaaaaactaatgtcaaataatgtacaaatagtaagacaacaaagctactccatcatgtgtataataaaagaagaagtactagcatacgtagttcaactaccactttacggcgtaatcgacaccccttgctggaaactacacacctcccctctatgcaccacaaacacaaaagaaggttccaacatatgccttaccagaacagacagaggctggtattgcgacaacgcaggatcagtttcattttttccacaagctgaaacatgcaaagtacaatcaaacagagtcttctgcgacacaatgaactcaagaactctaccctcagaagtaaacctatgtaacgtagacattttcaaccccaaatacgactgcaaaattatgacatcaaaaacagacgtttcatcatcagttatcacctcattaggagcaatagtaagctgctacggaaaaacaaaatgcaccgcctcaaataaatgcagaggaataataaaaactttctccaacggatgcgactacgtttcaaacaaaggtgtagacactgtatcagtaggaaacacactatattacgtaaataaacaagaaggaaaatcactttatgtcaaaggagaaccaataatcaatttctacgacccattagtattcccatcagacgaatttgatgcttcaatatcacaagtaaacgaaaaaataaatcaatcactcgcatttatacgaaaatcagacgaactactacacaatgtaaacgcaggcaaatcaacaacaaacataatgataacaacaataatcattgtaataatagtaatacttctatctctaatagcagtaggattactcctctactgcaaagcaagatcaacccctgtaacactatcaaaagaccaactttcaggtataaataatatagctttttccaattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5518 - RNA, 1892 nt, synthetic construct
  misc_feature 1..1892: note = mRNA product Design e-3 comprising derived and/or modified sequence from HRSV(A2)__F_DSCav1_mut5 (opt11)
  source 1..1892: mol_type = other RNA
gggagactttcccattctgtagcagaatttggtgttgcctgtggtcttggtcccgcggagaagcttaccatggagctcctaatcctcaaagccaacgcgatcactacaatcctcacagccgtcaccttctgcttcgcctccggccaaaacatcaccgaggagttctaccaatcaacctgctccgccgtatcaaaaggatacctaagcgccctacggaccggctggtacacatctgtcatcaccatcgaactatcaaacatcaaagaaaacaaatgcaacggaaccgacgcaaaagtcaaactgattaaacaagaactagacaaatacaaaaacgcagtcaccgaactgcaattactcatgcaaagcacaccggccaccggctcaggcagcgccatcgcctccggcgtcgccgtctgcaaagttctccacctcgagggcgaagtcaacaaaataaaatctgccctcctctccaccaacaaagccgtcgtctccctcagcggctgcggagtctccgtcctcaccttcaaagttctcgatctcaagaactatattgacaaacaacttctacccatactcaacaaacaaagctgcagcatatccaacatcgaaaccgtcatcgagttccaacaaaagaacaaccgcctcctcgaaataacccgcgagttcagcgttaacgccggagtcactacccctgtctccacctacatgctcaccaactccgaactcctatcactaatcaacgacatgcccataaccaacgaccagaagaaactcatgtccaacaacgtccaaattgtccgacaacaaagctactccataatgtgcataataaaagaggaagtcctcgcctacgtcgtacaactgcccctttatggcgtaatcgacacaccctgctggaaactccacacgtcacccctctgcaccaccaacacaaaagaaggctcgaacatctgcctaacacggactgaccgcggctggtactgcgacaacgccggctccgtcagcttcttcccacaagccgaaacctgcaaagtacaatccaaccgagtattctgcgacaccatgaactccagaaccctcccctcagaggtcaacctgtgcaacgtagacatcttcaaccccaaatacgactgcaaaataatgacctcaaaaacagacgtctcctcttccgtaatcaccagcctcggagccatcgtcagctgctacggcaaaaccaaatgcaccgcctcaaacaaatgccgcggcatcatcaaaacattctcaaacggctgcgactacgtctccaacaaaggcgtcgacacagtaagcgtaggcaacacactgtactacgtcaacaaacaagagggaaaatcactctacgtcaaaggagaacccataatcaacttctacgaccccctcgttttccccagcgacgagttcgacgccagcatatcccaagtcaacgagaaaattaaccaatccctagcattcatccgaaaatctgacgaactgctccacaacgtcaacgcgggaaaatcaacaaccaacataatgataaccacaatcataatagtcatcatcgtaatcctcctcagcctaatcgctgtcggcctcctcctctactgcaaagcccgttccaccccagtcacactttccaaggaccaactaagcggaataaacaacatcgcgttctcaaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5519 - RNA, 1946 nt, synthetic construct
  misc_feature 1..1946: note = mRNA product Design e-4 comprising derived and/or modified sequence from HRSV(A2)__F_DSCav1_mut5 (opt1)
  source 1..1946: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5520 - RNA, 1946 nt, synthetic construct
  misc_feature 1..1946: note = mRNA product Design e-4 comprising derived and/or modified sequence from HRSV(A2)__F_DSCav1_mut5 (opt1)
  source 1..1946: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcgggtgcggcgtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggggtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggcgtgatcgacacgccgtgctggaagctgcacaccagccccctctgcaccaccaacacgaaggaggggtccaacatctgcctgacccgcaccgaccggggctggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggggccatcgtgtcctgctacggcaagaccaagtgcaccgccagcaacaagtgccgggggatcatcaagaccttctccaacggctgcgactacgtgagcaacaagggcgtcgacacggtgagcgtggggaacaccctctactacgtcaacaagcaggagggcaagtccctgtacgtgaagggggagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccggcaagtccaccaccaacatcatgatcaccacgatcatcatcgtgatcatcgtcatcctcctgagcctgatcgccgtggggctcctgctgtactgcaaggcccggtccaccccggtgaccctgagcaaggaccagctctccggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5521 - RNA, 1946 nt, synthetic construct
  misc_feature 1..1946: note = mRNA product Design e-4 comprising derived and/or modified sequence from HRSV(A2)__F_DSCav1_mut5 (opt2)
  source 1..1946: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5522 - RNA, 1946 nt, synthetic construct
  misc_feature 1..1946: note = mRNA product Design e-4 comprising derived and/or modified sequence from HRSV(A2)__F_DSCav1_mut5 (opt3)
  source 1..1946: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcggttgcggggtgtccgtattaacttttaaggttctggaccttaagaactacattgataaacaattgctgcctatcctaaataagcagtcatgtagtattagcaacatcgagaccgtgatagagttccagcagaaaaataacaggctcctggaaattacacgggagttttctgtcaatgcgggagtgactaccccagtgtccacatatatgcttaccaactcagaactgttgagcctcatcaatgacatgccgattacgaacgatcaaaagaaactgatgagtaacaatgtccagatcgttcgccagcagtcttactccatcatgtgcattataaaggaggaagtgttagcatatgtagtgcaactgcccctctacggcgtcatcgacactccttgttggaaacttcatacaagcccactgtgcaccactaacacaaaggagggctcgaatatttgtttgacccgaacggatcgtgggtggtactgcgacaacgccggatctgtgtccttctttccccaggctgaaacctgtaaggttcagtcaaatagagtgttctgcgatacaatgaacagtagaactctgcctagcgaggtcaatctctgcaacgtggacatctttaatccaaaatatgattgtaagataatgacctccaaaacagacgtatctagctcagttattaccagtctgggtgccatcgtgtcctgctacggcaagactaaatgtacagcaagcaacaagtgcagggggatcattaagaccttctctaatggatgtgattatgtctcaaacaaaggcgtggacactgtcagtgtgggtaatacgctttactatgttaacaagcaagaggggaaaagcctgtacgtgaagggagaacccatcattaatttttatgaccctttggtattcccatccgatgagtttgacgcttctatatcgcaggtcaacgagaaaatcaaccagagcctcgccttcattcggaagtccgatgaactgttacacaatgtgaacgcgggcaagtcaacaaccaatatcatgatcactaccattataatcgttattatcgtgattctgctaagtctcatcgccgtcggcctgcttttgtactgcaaagcacgctctacaccggtgaccctgagcaaggaccagctctccgggataaacaatatcgctttctcaaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5523 - RNA, 1946 nt, synthetic construct
  misc_feature 1..1946: note = mRNA product Design e-4 comprising derived and/or modified sequence from HRSV(A2)__F_DSCav1_mut5 (opt4)
  source 1..1946: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5524 - RNA, 1946 nt, synthetic construct
  misc_feature 1..1946: note = mRNA product Design e-4 comprising derived and/or modified sequence from HRSV(A2)__F_DSCav1_mut5 (opt5)
  source 1..1946: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcggatgcggcgtttctgtgctgacatttaaggtccttgacctgaagaactacattgataaacaactcctgcctatcctgaataagcagtcctgtagcatttctaacatcgagaccgtgattgagttccagcagaaaaataaccggctcctggaaatcacgcgcgagttttccgtgaatgccggcgtcacaaccccggttagcacatatatgcttaccaactccgaactgctctctctgatcaatgacatgcccattaccaacgatcaaaagaaacttatgagcaacaatgtgcagatcgtgagacagcagtcctacagcattatgtgcatcattaaggaggaagtcctggcttatgtggttcaactccctctgtacggggtgatcgacacaccctgttggaaactgcatacgtctcctctctgcaccacaaacaccaaggagggatccaatatctgtctgacacggaccgatcgcggctggtactgcgacaacgccgggagcgtctctttctttccccaggcggaaacgtgtaaggtgcagagcaatagagttttctgcgatacaatgaactccagaaccctgccttctgaggtgaatctctgcaacgtcgacatttttaatccgaaatatgattgtaagatcatgaccagcaaaacagacgtgtccagctctgtcattacctccctgggagccatcgtgagctgctacggcaagacaaaatgtacggcttctaacaagtgccgggggattatcaagaccttctccaatggatgtgattatgttagcaacaaaggcgtggacacagtctccgtgggcaataccctttactatgttaacaagcaagaggggaaatctctgtacgtgaagggagaacccatcattaatttttatgaccctctcgtcttccccagcgatgagtttgacgcctccatctctcaggtgaacgagaaaattaaccagagcctggctttcatccgcaagtccgatgaactgctccacaatgtgaacgccggcaagagcacaaccaatattatgatcacgaccattatcatcgttattatcgtcattctgctttctctgatcgccgtggggctcctgctgtactgcaaagctagatccacacctgtgacccttagcaaggaccagctctctggaattaacaatatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5525 - RNA, 1946 nt, synthetic construct
  misc_feature 1..1946: note = mRNA product Design e-4 comprising derived and/or modified sequence from HRSV(A2)__F_DSCav1_mut5 (opt6)
  source 1..1946: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactattaatacttaaagccaacgcaataacaacaattctcactgctgtcaccttctgcttcgcctcaggccaaaacataacggaagaattttaccaatcaacatgctctgcagtatccaaaggctacctatctgctctaagaacaggttggtatacatcagtaataaccatagaactatcaaacataaaagaaaataaatgcaacggaacagacgcaaaagttaaactcataaaacaagaactagacaaatataaaaacgcagttaccgaactacaactacttatgcaatccactcccgccactggatcaggatcagcaatagcatcaggagtcgcagtatgtaaagtcttacacctcgaaggcgaagtcaataaaatcaaatccgcattactatccacaaacaaagcagtcgtatccctaagcggatgcggagtatcagtactaacatttaaagtactagacctaaaaaattacatcgataaacaactattacctatattaaacaaacaatcctgctccatttcaaatatcgaaaccgtaatagaatttcaacaaaaaaacaacagattactagaaataacaagagaattttccgtaaatgctggcgtaacaacaccagtatccacatacatgctcacaaactccgaactactatcactaataaatgacatgcccataacaaacgatcaaaaaaaactaatgtcaaataatgtacaaatagtaagacaacaaagctactccatcatgtgtataataaaagaagaagtactagcatacgtagttcaactaccactttacggcgtaatcgacaccccttgctggaaactacacacctcccctctatgcaccacaaacacaaaagaaggttccaacatatgccttaccagaacagacagaggctggtattgcgacaacgcaggatcagtttcattttttccacaagctgaaacatgcaaagtacaatcaaacagagtcttctgcgacacaatgaactcaagaactctaccctcagaagtaaacctatgtaacgtagacattttcaaccccaaatacgactgcaaaattatgacatcaaaaacagacgtttcatcatcagttatcacctcattaggagcaatagtaagctgctacggaaaaacaaaatgcaccgcctcaaataaatgcagaggaataataaaaactttctccaacggatgcgactacgtttcaaacaaaggtgtagacactgtatcagtaggaaacacactatattacgtaaataaacaagaaggaaaatcactttatgtcaaaggagaaccaataatcaatttctacgacccattagtattcccatcagacgaatttgatgcttcaatatcacaagtaaacgaaaaaataaatcaatcactcgcatttatacgaaaatcagacgaactactacacaatgtaaacgcaggcaaatcaacaacaaacataatgataacaacaataatcattgtaataatagtaatacttctatctctaatagcagtaggattactcctctactgcaaagcaagatcaacccctgtaacactatcaaaagaccaactttcaggtataaataatatagctttttccaattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5526 - RNA, 1946 nt, synthetic construct
  misc_feature 1..1946: note = mRNA product Design e-4 comprising derived and/or modified sequence from HRSV(A2)__F_DSCav1_mut5 (opt11)
  source 1..1946: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctaatcctcaaagccaacgcgatcactacaatcctcacagccgtcaccttctgcttcgcctccggccaaaacatcaccgaggagttctaccaatcaacctgctccgccgtatcaaaaggatacctaagcgccctacggaccggctggtacacatctgtcatcaccatcgaactatcaaacatcaaagaaaacaaatgcaacggaaccgacgcaaaagtcaaactgattaaacaagaactagacaaatacaaaaacgcagtcaccgaactgcaattactcatgcaaagcacaccggccaccggctcaggcagcgccatcgcctccggcgtcgccgtctgcaaagttctccacctcgagggcgaagtcaacaaaataaaatctgccctcctctccaccaacaaagccgtcgtctccctcagcggctgcggagtctccgtcctcaccttcaaagttctcgatctcaagaactatattgacaaacaacttctacccatactcaacaaacaaagctgcagcatatccaacatcgaaaccgtcatcgagttccaacaaaagaacaaccgcctcctcgaaataacccgcgagttcagcgttaacgccggagtcactacccctgtctccacctacatgctcaccaactccgaactcctatcactaatcaacgacatgcccataaccaacgaccagaagaaactcatgtccaacaacgtccaaattgtccgacaacaaagctactccataatgtgcataataaaagaggaagtcctcgcctacgtcgtacaactgcccctttatggcgtaatcgacacaccctgctggaaactccacacgtcacccctctgcaccaccaacacaaaagaaggctcgaacatctgcctaacacggactgaccgcggctggtactgcgacaacgccggctccgtcagcttcttcccacaagccgaaacctgcaaagtacaatccaaccgagtattctgcgacaccatgaactccagaaccctcccctcagaggtcaacctgtgcaacgtagacatcttcaaccccaaatacgactgcaaaataatgacctcaaaaacagacgtctcctcttccgtaatcaccagcctcggagccatcgtcagctgctacggcaaaaccaaatgcaccgcctcaaacaaatgccgcggcatcatcaaaacattctcaaacggctgcgactacgtctccaacaaaggcgtcgacacagtaagcgtaggcaacacactgtactacgtcaacaaacaagagggaaaatcactctacgtcaaaggagaacccataatcaacttctacgaccccctcgttttccccagcgacgagttcgacgccagcatatcccaagtcaacgagaaaattaaccaatccctagcattcatccgaaaatctgacgaactgctccacaacgtcaacgcgggaaaatcaacaaccaacataatgataaccacaatcataatagtcatcatcgtaatcctcctcagcctaatcgctgtcggcctcctcctctactgcaaagcccgttccaccccagtcacactttccaaggaccaactaagcggaataaacaacatcgcgttctcaaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5527 - RNA, 1913 nt, synthetic construct
  misc_feature 1..1913: note = mRNA product Design e-5 comprising derived and/or modified sequence from HRSV(A2)__F_DSCav1_mut5 (opt1)
  source 1..1913: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5528 - RNA, 1913 nt, synthetic construct
  misc_feature 1..1913: note = mRNA product Design e-5 comprising derived and/or modified sequence from HRSV(A2)__F_DSCav1_mut5 (opt1)
  source 1..1913: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcgggtgcggcgtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggggtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggcgtgatcgacacgccgtgctggaagctgcacaccagccccctctgcaccaccaacacgaaggaggggtccaacatctgcctgacccgcaccgaccggggctggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggggccatcgtgtcctgctacggcaagaccaagtgcaccgccagcaacaagtgccgggggatcatcaagaccttctccaacggctgcgactacgtgagcaacaagggcgtcgacacggtgagcgtggggaacaccctctactacgtcaacaagcaggagggcaagtccctgtacgtgaagggggagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccggcaagtccaccaccaacatcatgatcaccacgatcatcatcgtgatcatcgtcatcctcctgagcctgatcgccgtggggctcctgctgtactgcaaggcccggtccaccccggtgaccctgagcaaggaccagctctccggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5529 - RNA, 1913 nt, synthetic construct
  misc_feature 1..1913: note = mRNA product Design e-5 comprising derived and/or modified sequence from HRSV(A2)__F_DSCav1_mut5 (opt2)
  source 1..1913: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5530 - RNA, 1913 nt, synthetic construct
  misc_feature 1..1913: note = mRNA product Design e-5 comprising derived and/or modified sequence from HRSV(A2)__F_DSCav1_mut5 (opt3)
  source 1..1913: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcggttgcggggtgtccgtattaacttttaaggttctggaccttaagaactacattgataaacaattgctgcctatcctaaataagcagtcatgtagtattagcaacatcgagaccgtgatagagttccagcagaaaaataacaggctcctggaaattacacgggagttttctgtcaatgcgggagtgactaccccagtgtccacatatatgcttaccaactcagaactgttgagcctcatcaatgacatgccgattacgaacgatcaaaagaaactgatgagtaacaatgtccagatcgttcgccagcagtcttactccatcatgtgcattataaaggaggaagtgttagcatatgtagtgcaactgcccctctacggcgtcatcgacactccttgttggaaacttcatacaagcccactgtgcaccactaacacaaaggagggctcgaatatttgtttgacccgaacggatcgtgggtggtactgcgacaacgccggatctgtgtccttctttccccaggctgaaacctgtaaggttcagtcaaatagagtgttctgcgatacaatgaacagtagaactctgcctagcgaggtcaatctctgcaacgtggacatctttaatccaaaatatgattgtaagataatgacctccaaaacagacgtatctagctcagttattaccagtctgggtgccatcgtgtcctgctacggcaagactaaatgtacagcaagcaacaagtgcagggggatcattaagaccttctctaatggatgtgattatgtctcaaacaaaggcgtggacactgtcagtgtgggtaatacgctttactatgttaacaagcaagaggggaaaagcctgtacgtgaagggagaacccatcattaatttttatgaccctttggtattcccatccgatgagtttgacgcttctatatcgcaggtcaacgagaaaatcaaccagagcctcgccttcattcggaagtccgatgaactgttacacaatgtgaacgcgggcaagtcaacaaccaatatcatgatcactaccattataatcgttattatcgtgattctgctaagtctcatcgccgtcggcctgcttttgtactgcaaagcacgctctacaccggtgaccctgagcaaggaccagctctccgggataaacaatatcgctttctcaaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5531 - RNA, 1913 nt, synthetic construct
  misc_feature 1..1913: note = mRNA product Design e-5 comprising derived and/or modified sequence from HRSV(A2)__F_DSCav1_mut5 (opt4)
  source 1..1913: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5532 - RNA, 1913 nt, synthetic construct
  misc_feature 1..1913: note = mRNA product Design e-5 comprising derived and/or modified sequence from HRSV(A2)__F_DSCav1_mut5 (opt5)
  source 1..1913: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcggatgcggcgtttctgtgctgacatttaaggtccttgacctgaagaactacattgataaacaactcctgcctatcctgaataagcagtcctgtagcatttctaacatcgagaccgtgattgagttccagcagaaaaataaccggctcctggaaatcacgcgcgagttttccgtgaatgccggcgtcacaaccccggttagcacatatatgcttaccaactccgaactgctctctctgatcaatgacatgcccattaccaacgatcaaaagaaacttatgagcaacaatgtgcagatcgtgagacagcagtcctacagcattatgtgcatcattaaggaggaagtcctggcttatgtggttcaactccctctgtacggggtgatcgacacaccctgttggaaactgcatacgtctcctctctgcaccacaaacaccaaggagggatccaatatctgtctgacacggaccgatcgcggctggtactgcgacaacgccgggagcgtctctttctttccccaggcggaaacgtgtaaggtgcagagcaatagagttttctgcgatacaatgaactccagaaccctgccttctgaggtgaatctctgcaacgtcgacatttttaatccgaaatatgattgtaagatcatgaccagcaaaacagacgtgtccagctctgtcattacctccctgggagccatcgtgagctgctacggcaagacaaaatgtacggcttctaacaagtgccgggggattatcaagaccttctccaatggatgtgattatgttagcaacaaaggcgtggacacagtctccgtgggcaataccctttactatgttaacaagcaagaggggaaatctctgtacgtgaagggagaacccatcattaatttttatgaccctctcgtcttccccagcgatgagtttgacgcctccatctctcaggtgaacgagaaaattaaccagagcctggctttcatccgcaagtccgatgaactgctccacaatgtgaacgccggcaagagcacaaccaatattatgatcacgaccattatcatcgttattatcgtcattctgctttctctgatcgccgtggggctcctgctgtactgcaaagctagatccacacctgtgacccttagcaaggaccagctctctggaattaacaatatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5533 - RNA, 1913 nt, synthetic construct
  misc_feature 1..1913: note = mRNA product Design e-5 comprising derived and/or modified sequence from HRSV(A2)__F_DSCav1_mut5 (opt6)
  source 1..1913: mol_type = other RNA
gggagagcggctcggccattttgtcccagtcagtccggaggctgcggctgcagaagtaccgcctgcggagtaactgcaaagaagcttaccatggaactattaatacttaaagccaacgcaataacaacaattctcactgctgtcaccttctgcttcgcctcaggccaaaacataacggaagaattttaccaatcaacatgctctgcagtatccaaaggctacctatctgctctaagaacaggttggtatacatcagtaataaccatagaactatcaaacataaaagaaaataaatgcaacggaacagacgcaaaagttaaactcataaaacaagaactagacaaatataaaaacgcagttaccgaactacaactacttatgcaatccactcccgccactggatcaggatcagcaatagcatcaggagtcgcagtatgtaaagtcttacacctcgaaggcgaagtcaataaaatcaaatccgcattactatccacaaacaaagcagtcgtatccctaagcggatgcggagtatcagtactaacatttaaagtactagacctaaaaaattacatcgataaacaactattacctatattaaacaaacaatcctgctccatttcaaatatcgaaaccgtaatagaatttcaacaaaaaaacaacagattactagaaataacaagagaattttccgtaaatgctggcgtaacaacaccagtatccacatacatgctcacaaactccgaactactatcactaataaatgacatgcccataacaaacgatcaaaaaaaactaatgtcaaataatgtacaaatagtaagacaacaaagctactccatcatgtgtataataaaagaagaagtactagcatacgtagttcaactaccactttacggcgtaatcgacaccccttgctggaaactacacacctcccctctatgcaccacaaacacaaaagaaggttccaacatatgccttaccagaacagacagaggctggtattgcgacaacgcaggatcagtttcattttttccacaagctgaaacatgcaaagtacaatcaaacagagtcttctgcgacacaatgaactcaagaactctaccctcagaagtaaacctatgtaacgtagacattttcaaccccaaatacgactgcaaaattatgacatcaaaaacagacgtttcatcatcagttatcacctcattaggagcaatagtaagctgctacggaaaaacaaaatgcaccgcctcaaataaatgcagaggaataataaaaactttctccaacggatgcgactacgtttcaaacaaaggtgtagacactgtatcagtaggaaacacactatattacgtaaataaacaagaaggaaaatcactttatgtcaaaggagaaccaataatcaatttctacgacccattagtattcccatcagacgaatttgatgcttcaatatcacaagtaaacgaaaaaataaatcaatcactcgcatttatacgaaaatcagacgaactactacacaatgtaaacgcaggcaaatcaacaacaaacataatgataacaacaataatcattgtaataatagtaatacttctatctctaatagcagtaggattactcctctactgcaaagcaagatcaacccctgtaacactatcaaaagaccaactttcaggtataaataatatagctttttccaattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5534 - RNA, 1913 nt, synthetic construct
  misc_feature 1..1913: note = mRNA product Design e-5 comprising derived and/or modified sequence from HRSV(A2)__F_DSCav1_mut5 (opt11)
  source 1..1913: mol_type = other RNA
gggagagcggctcggccattttgtcccagtcagtccggaggctgcggctgcagaagtaccgcctgcggagtaactgcaaagaagcttaccatggagctcctaatcctcaaagccaacgcgatcactacaatcctcacagccgtcaccttctgcttcgcctccggccaaaacatcaccgaggagttctaccaatcaacctgctccgccgtatcaaaaggatacctaagcgccctacggaccggctggtacacatctgtcatcaccatcgaactatcaaacatcaaagaaaacaaatgcaacggaaccgacgcaaaagtcaaactgattaaacaagaactagacaaatacaaaaacgcagtcaccgaactgcaattactcatgcaaagcacaccggccaccggctcaggcagcgccatcgcctccggcgtcgccgtctgcaaagttctccacctcgagggcgaagtcaacaaaataaaatctgccctcctctccaccaacaaagccgtcgtctccctcagcggctgcggagtctccgtcctcaccttcaaagttctcgatctcaagaactatattgacaaacaacttctacccatactcaacaaacaaagctgcagcatatccaacatcgaaaccgtcatcgagttccaacaaaagaacaaccgcctcctcgaaataacccgcgagttcagcgttaacgccggagtcactacccctgtctccacctacatgctcaccaactccgaactcctatcactaatcaacgacatgcccataaccaacgaccagaagaaactcatgtccaacaacgtccaaattgtccgacaacaaagctactccataatgtgcataataaaagaggaagtcctcgcctacgtcgtacaactgcccctttatggcgtaatcgacacaccctgctggaaactccacacgtcacccctctgcaccaccaacacaaaagaaggctcgaacatctgcctaacacggactgaccgcggctggtactgcgacaacgccggctccgtcagcttcttcccacaagccgaaacctgcaaagtacaatccaaccgagtattctgcgacaccatgaactccagaaccctcccctcagaggtcaacctgtgcaacgtagacatcttcaaccccaaatacgactgcaaaataatgacctcaaaaacagacgtctcctcttccgtaatcaccagcctcggagccatcgtcagctgctacggcaaaaccaaatgcaccgcctcaaacaaatgccgcggcatcatcaaaacattctcaaacggctgcgactacgtctccaacaaaggcgtcgacacagtaagcgtaggcaacacactgtactacgtcaacaaacaagagggaaaatcactctacgtcaaaggagaacccataatcaacttctacgaccccctcgttttccccagcgacgagttcgacgccagcatatcccaagtcaacgagaaaattaaccaatccctagcattcatccgaaaatctgacgaactgctccacaacgtcaacgcgggaaaatcaacaaccaacataatgataaccacaatcataatagtcatcatcgtaatcctcctcagcctaatcgctgtcggcctcctcctctactgcaaagcccgttccaccccagtcacactttccaaggaccaactaagcggaataaacaacatcgcgttctcaaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5535 - RNA, 1980 nt, synthetic construct
  misc_feature 1..1980: note = mRNA product Design e-6 comprising derived and/or modified sequence from HRSV(A2)__F_DSCav1_mut5 (opt1)
  source 1..1980: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5536 - RNA, 1980 nt, synthetic construct
  misc_feature 1..1980: note = mRNA product Design e-6 comprising derived and/or modified sequence from HRSV(A2)__F_DSCav1_mut5 (opt1)
  source 1..1980: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcgggtgcggcgtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggggtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggcgtgatcgacacgccgtgctggaagctgcacaccagccccctctgcaccaccaacacgaaggaggggtccaacatctgcctgacccgcaccgaccggggctggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggggccatcgtgtcctgctacggcaagaccaagtgcaccgccagcaacaagtgccgggggatcatcaagaccttctccaacggctgcgactacgtgagcaacaagggcgtcgacacggtgagcgtggggaacaccctctactacgtcaacaagcaggagggcaagtccctgtacgtgaagggggagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccggcaagtccaccaccaacatcatgatcaccacgatcatcatcgtgatcatcgtcatcctcctgagcctgatcgccgtggggctcctgctgtactgcaaggcccggtccaccccggtgaccctgagcaaggaccagctctccggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5537 - RNA, 1980 nt, synthetic construct
  misc_feature 1..1980: note = mRNA product Design e-6 comprising derived and/or modified sequence from HRSV(A2)__F_DSCav1_mut5 (opt2)
  source 1..1980: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5538 - RNA, 1980 nt, synthetic construct
  misc_feature 1..1980: note = mRNA product Design e-6 comprising derived and/or modified sequence from HRSV(A2)__F_DSCav1_mut5 (opt3)
  source 1..1980: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcggttgcggggtgtccgtattaacttttaaggttctggaccttaagaactacattgataaacaattgctgcctatcctaaataagcagtcatgtagtattagcaacatcgagaccgtgatagagttccagcagaaaaataacaggctcctggaaattacacgggagttttctgtcaatgcgggagtgactaccccagtgtccacatatatgcttaccaactcagaactgttgagcctcatcaatgacatgccgattacgaacgatcaaaagaaactgatgagtaacaatgtccagatcgttcgccagcagtcttactccatcatgtgcattataaaggaggaagtgttagcatatgtagtgcaactgcccctctacggcgtcatcgacactccttgttggaaacttcatacaagcccactgtgcaccactaacacaaaggagggctcgaatatttgtttgacccgaacggatcgtgggtggtactgcgacaacgccggatctgtgtccttctttccccaggctgaaacctgtaaggttcagtcaaatagagtgttctgcgatacaatgaacagtagaactctgcctagcgaggtcaatctctgcaacgtggacatctttaatccaaaatatgattgtaagataatgacctccaaaacagacgtatctagctcagttattaccagtctgggtgccatcgtgtcctgctacggcaagactaaatgtacagcaagcaacaagtgcagggggatcattaagaccttctctaatggatgtgattatgtctcaaacaaaggcgtggacactgtcagtgtgggtaatacgctttactatgttaacaagcaagaggggaaaagcctgtacgtgaagggagaacccatcattaatttttatgaccctttggtattcccatccgatgagtttgacgcttctatatcgcaggtcaacgagaaaatcaaccagagcctcgccttcattcggaagtccgatgaactgttacacaatgtgaacgcgggcaagtcaacaaccaatatcatgatcactaccattataatcgttattatcgtgattctgctaagtctcatcgccgtcggcctgcttttgtactgcaaagcacgctctacaccggtgaccctgagcaaggaccagctctccgggataaacaatatcgctttctcaaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5539 - RNA, 1980 nt, synthetic construct
  misc_feature 1..1980: note = mRNA product Design e-6 comprising derived and/or modified sequence from HRSV(A2)__F_DSCav1_mut5 (opt4)
  source 1..1980: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5540 - RNA, 1980 nt, synthetic construct
  misc_feature 1..1980: note = mRNA product Design e-6 comprising derived and/or modified sequence from HRSV(A2)__F_DSCav1_mut5 (opt5)
  source 1..1980: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcggatgcggcgtttctgtgctgacatttaaggtccttgacctgaagaactacattgataaacaactcctgcctatcctgaataagcagtcctgtagcatttctaacatcgagaccgtgattgagttccagcagaaaaataaccggctcctggaaatcacgcgcgagttttccgtgaatgccggcgtcacaaccccggttagcacatatatgcttaccaactccgaactgctctctctgatcaatgacatgcccattaccaacgatcaaaagaaacttatgagcaacaatgtgcagatcgtgagacagcagtcctacagcattatgtgcatcattaaggaggaagtcctggcttatgtggttcaactccctctgtacggggtgatcgacacaccctgttggaaactgcatacgtctcctctctgcaccacaaacaccaaggagggatccaatatctgtctgacacggaccgatcgcggctggtactgcgacaacgccgggagcgtctctttctttccccaggcggaaacgtgtaaggtgcagagcaatagagttttctgcgatacaatgaactccagaaccctgccttctgaggtgaatctctgcaacgtcgacatttttaatccgaaatatgattgtaagatcatgaccagcaaaacagacgtgtccagctctgtcattacctccctgggagccatcgtgagctgctacggcaagacaaaatgtacggcttctaacaagtgccgggggattatcaagaccttctccaatggatgtgattatgttagcaacaaaggcgtggacacagtctccgtgggcaataccctttactatgttaacaagcaagaggggaaatctctgtacgtgaagggagaacccatcattaatttttatgaccctctcgtcttccccagcgatgagtttgacgcctccatctctcaggtgaacgagaaaattaaccagagcctggctttcatccgcaagtccgatgaactgctccacaatgtgaacgccggcaagagcacaaccaatattatgatcacgaccattatcatcgttattatcgtcattctgctttctctgatcgccgtggggctcctgctgtactgcaaagctagatccacacctgtgacccttagcaaggaccagctctctggaattaacaatatcgcgttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5541 - RNA, 1980 nt, synthetic construct
  misc_feature 1..1980: note = mRNA product Design e-6 comprising derived and/or modified sequence from HRSV(A2)__F_DSCav1_mut5 (opt6)
  source 1..1980: mol_type = other RNA
gggagagcggctcggccattttgtcccagtcagtccggaggctgcggctgcagaagtaccgcctgcggagtaactgcaaagaagcttaccatggaactattaatacttaaagccaacgcaataacaacaattctcactgctgtcaccttctgcttcgcctcaggccaaaacataacggaagaattttaccaatcaacatgctctgcagtatccaaaggctacctatctgctctaagaacaggttggtatacatcagtaataaccatagaactatcaaacataaaagaaaataaatgcaacggaacagacgcaaaagttaaactcataaaacaagaactagacaaatataaaaacgcagttaccgaactacaactacttatgcaatccactcccgccactggatcaggatcagcaatagcatcaggagtcgcagtatgtaaagtcttacacctcgaaggcgaagtcaataaaatcaaatccgcattactatccacaaacaaagcagtcgtatccctaagcggatgcggagtatcagtactaacatttaaagtactagacctaaaaaattacatcgataaacaactattacctatattaaacaaacaatcctgctccatttcaaatatcgaaaccgtaatagaatttcaacaaaaaaacaacagattactagaaataacaagagaattttccgtaaatgctggcgtaacaacaccagtatccacatacatgctcacaaactccgaactactatcactaataaatgacatgcccataacaaacgatcaaaaaaaactaatgtcaaataatgtacaaatagtaagacaacaaagctactccatcatgtgtataataaaagaagaagtactagcatacgtagttcaactaccactttacggcgtaatcgacaccccttgctggaaactacacacctcccctctatgcaccacaaacacaaaagaaggttccaacatatgccttaccagaacagacagaggctggtattgcgacaacgcaggatcagtttcattttttccacaagctgaaacatgcaaagtacaatcaaacagagtcttctgcgacacaatgaactcaagaactctaccctcagaagtaaacctatgtaacgtagacattttcaaccccaaatacgactgcaaaattatgacatcaaaaacagacgtttcatcatcagttatcacctcattaggagcaatagtaagctgctacggaaaaacaaaatgcaccgcctcaaataaatgcagaggaataataaaaactttctccaacggatgcgactacgtttcaaacaaaggtgtagacactgtatcagtaggaaacacactatattacgtaaataaacaagaaggaaaatcactttatgtcaaaggagaaccaataatcaatttctacgacccattagtattcccatcagacgaatttgatgcttcaatatcacaagtaaacgaaaaaataaatcaatcactcgcatttatacgaaaatcagacgaactactacacaatgtaaacgcaggcaaatcaacaacaaacataatgataacaacaataatcattgtaataatagtaatacttctatctctaatagcagtaggattactcctctactgcaaagcaagatcaacccctgtaacactatcaaaagaccaactttcaggtataaataatatagctttttccaattaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5542 - RNA, 1980 nt, synthetic construct
  misc_feature 1..1980: note = mRNA product Design e-6 comprising derived and/or modified sequence from HRSV(A2)__F_DSCav1_mut5 (opt11)
  source 1..1980: mol_type = other RNA
gggagagcggctcggccattttgtcccagtcagtccggaggctgcggctgcagaagtaccgcctgcggagtaactgcaaagaagcttaccatggagctcctaatcctcaaagccaacgcgatcactacaatcctcacagccgtcaccttctgcttcgcctccggccaaaacatcaccgaggagttctaccaatcaacctgctccgccgtatcaaaaggatacctaagcgccctacggaccggctggtacacatctgtcatcaccatcgaactatcaaacatcaaagaaaacaaatgcaacggaaccgacgcaaaagtcaaactgattaaacaagaactagacaaatacaaaaacgcagtcaccgaactgcaattactcatgcaaagcacaccggccaccggctcaggcagcgccatcgcctccggcgtcgccgtctgcaaagttctccacctcgagggcgaagtcaacaaaataaaatctgccctcctctccaccaacaaagccgtcgtctccctcagcggctgcggagtctccgtcctcaccttcaaagttctcgatctcaagaactatattgacaaacaacttctacccatactcaacaaacaaagctgcagcatatccaacatcgaaaccgtcatcgagttccaacaaaagaacaaccgcctcctcgaaataacccgcgagttcagcgttaacgccggagtcactacccctgtctccacctacatgctcaccaactccgaactcctatcactaatcaacgacatgcccataaccaacgaccagaagaaactcatgtccaacaacgtccaaattgtccgacaacaaagctactccataatgtgcataataaaagaggaagtcctcgcctacgtcgtacaactgcccctttatggcgtaatcgacacaccctgctggaaactccacacgtcacccctctgcaccaccaacacaaaagaaggctcgaacatctgcctaacacggactgaccgcggctggtactgcgacaacgccggctccgtcagcttcttcccacaagccgaaacctgcaaagtacaatccaaccgagtattctgcgacaccatgaactccagaaccctcccctcagaggtcaacctgtgcaacgtagacatcttcaaccccaaatacgactgcaaaataatgacctcaaaaacagacgtctcctcttccgtaatcaccagcctcggagccatcgtcagctgctacggcaaaaccaaatgcaccgcctcaaacaaatgccgcggcatcatcaaaacattctcaaacggctgcgactacgtctccaacaaaggcgtcgacacagtaagcgtaggcaacacactgtactacgtcaacaaacaagagggaaaatcactctacgtcaaaggagaacccataatcaacttctacgaccccctcgttttccccagcgacgagttcgacgccagcatatcccaagtcaacgagaaaattaaccaatccctagcattcatccgaaaatctgacgaactgctccacaacgtcaacgcgggaaaatcaacaaccaacataatgataaccacaatcataatagtcatcatcgtaatcctcctcagcctaatcgctgtcggcctcctcctctactgcaaagcccgttccaccccagtcacactttccaaggaccaactaagcggaataaacaacatcgcgttctcaaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5543 - RNA, 2196 nt, synthetic construct
  misc_feature 1..2196: note = mRNA product Design f-1 comprising derived and/or modified sequence from HRSV(A2)__F_DSCav1_mut5 (opt1)
  source 1..2196: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5544 - RNA, 2196 nt, synthetic construct
  misc_feature 1..2196: note = mRNA product Design f-1 comprising derived and/or modified sequence from HRSV(A2)__F_DSCav1_mut5 (opt1)
  source 1..2196: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcgggtgcggcgtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggggtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggcgtgatcgacacgccgtgctggaagctgcacaccagccccctctgcaccaccaacacgaaggaggggtccaacatctgcctgacccgcaccgaccggggctggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggggccatcgtgtcctgctacggcaagaccaagtgcaccgccagcaacaagtgccgggggatcatcaagaccttctccaacggctgcgactacgtgagcaacaagggcgtcgacacggtgagcgtggggaacaccctctactacgtcaacaagcaggagggcaagtccctgtacgtgaagggggagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccggcaagtccaccaccaacatcatgatcaccacgatcatcatcgtgatcatcgtcatcctcctgagcctgatcgccgtggggctcctgctgtactgcaaggcccggtccaccccggtgaccctgagcaaggaccagctctccggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5545 - RNA, 2196 nt, synthetic construct
  misc_feature 1..2196: note = mRNA product Design f-1 comprising derived and/or modified sequence from HRSV(A2)__F_DSCav1_mut5 (opt2)
  source 1..2196: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5546 - RNA, 2196 nt, synthetic construct
  misc_feature 1..2196: note = mRNA product Design f-1 comprising derived and/or modified sequence from HRSV(A2)__F_DSCav1_mut5 (opt3)
  source 1..2196: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcggttgcggggtgtccgtattaacttttaaggttctggaccttaagaactacattgataaacaattgctgcctatcctaaataagcagtcatgtagtattagcaacatcgagaccgtgatagagttccagcagaaaaataacaggctcctggaaattacacgggagttttctgtcaatgcgggagtgactaccccagtgtccacatatatgcttaccaactcagaactgttgagcctcatcaatgacatgccgattacgaacgatcaaaagaaactgatgagtaacaatgtccagatcgttcgccagcagtcttactccatcatgtgcattataaaggaggaagtgttagcatatgtagtgcaactgcccctctacggcgtcatcgacactccttgttggaaacttcatacaagcccactgtgcaccactaacacaaaggagggctcgaatatttgtttgacccgaacggatcgtgggtggtactgcgacaacgccggatctgtgtccttctttccccaggctgaaacctgtaaggttcagtcaaatagagtgttctgcgatacaatgaacagtagaactctgcctagcgaggtcaatctctgcaacgtggacatctttaatccaaaatatgattgtaagataatgacctccaaaacagacgtatctagctcagttattaccagtctgggtgccatcgtgtcctgctacggcaagactaaatgtacagcaagcaacaagtgcagggggatcattaagaccttctctaatggatgtgattatgtctcaaacaaaggcgtggacactgtcagtgtgggtaatacgctttactatgttaacaagcaagaggggaaaagcctgtacgtgaagggagaacccatcattaatttttatgaccctttggtattcccatccgatgagtttgacgcttctatatcgcaggtcaacgagaaaatcaaccagagcctcgccttcattcggaagtccgatgaactgttacacaatgtgaacgcgggcaagtcaacaaccaatatcatgatcactaccattataatcgttattatcgtgattctgctaagtctcatcgccgtcggcctgcttttgtactgcaaagcacgctctacaccggtgaccctgagcaaggaccagctctccgggataaacaatatcgctttctcaaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5547 - RNA, 2196 nt, synthetic construct
  misc_feature 1..2196: note = mRNA product Design f-1 comprising derived and/or modified sequence from HRSV(A2)__F_DSCav1_mut5 (opt4)
  source 1..2196: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5548 - RNA, 2196 nt, synthetic construct
  misc_feature 1..2196: note = mRNA product Design f-1 comprising derived and/or modified sequence from HRSV(A2)__F_DSCav1_mut5 (opt5)
  source 1..2196: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcggatgcggcgtttctgtgctgacatttaaggtccttgacctgaagaactacattgataaacaactcctgcctatcctgaataagcagtcctgtagcatttctaacatcgagaccgtgattgagttccagcagaaaaataaccggctcctggaaatcacgcgcgagttttccgtgaatgccggcgtcacaaccccggttagcacatatatgcttaccaactccgaactgctctctctgatcaatgacatgcccattaccaacgatcaaaagaaacttatgagcaacaatgtgcagatcgtgagacagcagtcctacagcattatgtgcatcattaaggaggaagtcctggcttatgtggttcaactccctctgtacggggtgatcgacacaccctgttggaaactgcatacgtctcctctctgcaccacaaacaccaaggagggatccaatatctgtctgacacggaccgatcgcggctggtactgcgacaacgccgggagcgtctctttctttccccaggcggaaacgtgtaaggtgcagagcaatagagttttctgcgatacaatgaactccagaaccctgccttctgaggtgaatctctgcaacgtcgacatttttaatccgaaatatgattgtaagatcatgaccagcaaaacagacgtgtccagctctgtcattacctccctgggagccatcgtgagctgctacggcaagacaaaatgtacggcttctaacaagtgccgggggattatcaagaccttctccaatggatgtgattatgttagcaacaaaggcgtggacacagtctccgtgggcaataccctttactatgttaacaagcaagaggggaaatctctgtacgtgaagggagaacccatcattaatttttatgaccctctcgtcttccccagcgatgagtttgacgcctccatctctcaggtgaacgagaaaattaaccagagcctggctttcatccgcaagtccgatgaactgctccacaatgtgaacgccggcaagagcacaaccaatattatgatcacgaccattatcatcgttattatcgtcattctgctttctctgatcgccgtggggctcctgctgtactgcaaagctagatccacacctgtgacccttagcaaggaccagctctctggaattaacaatatcgcgttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5549 - RNA, 2196 nt, synthetic construct
  misc_feature 1..2196: note = mRNA product Design f-1 comprising derived and/or modified sequence from HRSV(A2)__F_DSCav1_mut5 (opt6)
  source 1..2196: mol_type = other RNA
gggagagcggctcggccattttgtcccagtcagtccggaggctgcggctgcagaagtaccgcctgcggagtaactgcaaagaagcttaccatggaactattaatacttaaagccaacgcaataacaacaattctcactgctgtcaccttctgcttcgcctcaggccaaaacataacggaagaattttaccaatcaacatgctctgcagtatccaaaggctacctatctgctctaagaacaggttggtatacatcagtaataaccatagaactatcaaacataaaagaaaataaatgcaacggaacagacgcaaaagttaaactcataaaacaagaactagacaaatataaaaacgcagttaccgaactacaactacttatgcaatccactcccgccactggatcaggatcagcaatagcatcaggagtcgcagtatgtaaagtcttacacctcgaaggcgaagtcaataaaatcaaatccgcattactatccacaaacaaagcagtcgtatccctaagcggatgcggagtatcagtactaacatttaaagtactagacctaaaaaattacatcgataaacaactattacctatattaaacaaacaatcctgctccatttcaaatatcgaaaccgtaatagaatttcaacaaaaaaacaacagattactagaaataacaagagaattttccgtaaatgctggcgtaacaacaccagtatccacatacatgctcacaaactccgaactactatcactaataaatgacatgcccataacaaacgatcaaaaaaaactaatgtcaaataatgtacaaatagtaagacaacaaagctactccatcatgtgtataataaaagaagaagtactagcatacgtagttcaactaccactttacggcgtaatcgacaccccttgctggaaactacacacctcccctctatgcaccacaaacacaaaagaaggttccaacatatgccttaccagaacagacagaggctggtattgcgacaacgcaggatcagtttcattttttccacaagctgaaacatgcaaagtacaatcaaacagagtcttctgcgacacaatgaactcaagaactctaccctcagaagtaaacctatgtaacgtagacattttcaaccccaaatacgactgcaaaattatgacatcaaaaacagacgtttcatcatcagttatcacctcattaggagcaatagtaagctgctacggaaaaacaaaatgcaccgcctcaaataaatgcagaggaataataaaaactttctccaacggatgcgactacgtttcaaacaaaggtgtagacactgtatcagtaggaaacacactatattacgtaaataaacaagaaggaaaatcactttatgtcaaaggagaaccaataatcaatttctacgacccattagtattcccatcagacgaatttgatgcttcaatatcacaagtaaacgaaaaaataaatcaatcactcgcatttatacgaaaatcagacgaactactacacaatgtaaacgcaggcaaatcaacaacaaacataatgataacaacaataatcattgtaataatagtaatacttctatctctaatagcagtaggattactcctctactgcaaagcaagatcaacccctgtaacactatcaaaagaccaactttcaggtataaataatatagctttttccaattaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5550 - RNA, 2196 nt, synthetic construct
  misc_feature 1..2196: note = mRNA product Design f-1 comprising derived and/or modified sequence from HRSV(A2)__F_DSCav1_mut5 (opt11)
  source 1..2196: mol_type = other RNA
gggagagcggctcggccattttgtcccagtcagtccggaggctgcggctgcagaagtaccgcctgcggagtaactgcaaagaagcttaccatggagctcctaatcctcaaagccaacgcgatcactacaatcctcacagccgtcaccttctgcttcgcctccggccaaaacatcaccgaggagttctaccaatcaacctgctccgccgtatcaaaaggatacctaagcgccctacggaccggctggtacacatctgtcatcaccatcgaactatcaaacatcaaagaaaacaaatgcaacggaaccgacgcaaaagtcaaactgattaaacaagaactagacaaatacaaaaacgcagtcaccgaactgcaattactcatgcaaagcacaccggccaccggctcaggcagcgccatcgcctccggcgtcgccgtctgcaaagttctccacctcgagggcgaagtcaacaaaataaaatctgccctcctctccaccaacaaagccgtcgtctccctcagcggctgcggagtctccgtcctcaccttcaaagttctcgatctcaagaactatattgacaaacaacttctacccatactcaacaaacaaagctgcagcatatccaacatcgaaaccgtcatcgagttccaacaaaagaacaaccgcctcctcgaaataacccgcgagttcagcgttaacgccggagtcactacccctgtctccacctacatgctcaccaactccgaactcctatcactaatcaacgacatgcccataaccaacgaccagaagaaactcatgtccaacaacgtccaaattgtccgacaacaaagctactccataatgtgcataataaaagaggaagtcctcgcctacgtcgtacaactgcccctttatggcgtaatcgacacaccctgctggaaactccacacgtcacccctctgcaccaccaacacaaaagaaggctcgaacatctgcctaacacggactgaccgcggctggtactgcgacaacgccggctccgtcagcttcttcccacaagccgaaacctgcaaagtacaatccaaccgagtattctgcgacaccatgaactccagaaccctcccctcagaggtcaacctgtgcaacgtagacatcttcaaccccaaatacgactgcaaaataatgacctcaaaaacagacgtctcctcttccgtaatcaccagcctcggagccatcgtcagctgctacggcaaaaccaaatgcaccgcctcaaacaaatgccgcggcatcatcaaaacattctcaaacggctgcgactacgtctccaacaaaggcgtcgacacagtaagcgtaggcaacacactgtactacgtcaacaaacaagagggaaaatcactctacgtcaaaggagaacccataatcaacttctacgaccccctcgttttccccagcgacgagttcgacgccagcatatcccaagtcaacgagaaaattaaccaatccctagcattcatccgaaaatctgacgaactgctccacaacgtcaacgcgggaaaatcaacaaccaacataatgataaccacaatcataatagtcatcatcgtaatcctcctcagcctaatcgctgtcggcctcctcctctactgcaaagcccgttccaccccagtcacactttccaaggaccaactaagcggaataaacaacatcgcgttctcaaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5551 - RNA, 1976 nt, synthetic construct
  misc_feature 1..1976: note = mRNA product Design f-2 comprising derived and/or modified sequence from HRSV(A2)__F_DSCav1_mut5 (opt1)
  source 1..1976: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5552 - RNA, 1976 nt, synthetic construct
  misc_feature 1..1976: note = mRNA product Design f-2 comprising derived and/or modified sequence from HRSV(A2)__F_DSCav1_mut5 (opt1)
  source 1..1976: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcgggtgcggcgtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggggtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggcgtgatcgacacgccgtgctggaagctgcacaccagccccctctgcaccaccaacacgaaggaggggtccaacatctgcctgacccgcaccgaccggggctggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggggccatcgtgtcctgctacggcaagaccaagtgcaccgccagcaacaagtgccgggggatcatcaagaccttctccaacggctgcgactacgtgagcaacaagggcgtcgacacggtgagcgtggggaacaccctctactacgtcaacaagcaggagggcaagtccctgtacgtgaagggggagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccggcaagtccaccaccaacatcatgatcaccacgatcatcatcgtgatcatcgtcatcctcctgagcctgatcgccgtggggctcctgctgtactgcaaggcccggtccaccccggtgaccctgagcaaggaccagctctccggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5553 - RNA, 1976 nt, synthetic construct
  misc_feature 1..1976: note = mRNA product Design f-2 comprising derived and/or modified sequence from HRSV(A2)__F_DSCav1_mut5 (opt2)
  source 1..1976: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5554 - RNA, 1976 nt, synthetic construct
  misc_feature 1..1976: note = mRNA product Design f-2 comprising derived and/or modified sequence from HRSV(A2)__F_DSCav1_mut5 (opt3)
  source 1..1976: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcggttgcggggtgtccgtattaacttttaaggttctggaccttaagaactacattgataaacaattgctgcctatcctaaataagcagtcatgtagtattagcaacatcgagaccgtgatagagttccagcagaaaaataacaggctcctggaaattacacgggagttttctgtcaatgcgggagtgactaccccagtgtccacatatatgcttaccaactcagaactgttgagcctcatcaatgacatgccgattacgaacgatcaaaagaaactgatgagtaacaatgtccagatcgttcgccagcagtcttactccatcatgtgcattataaaggaggaagtgttagcatatgtagtgcaactgcccctctacggcgtcatcgacactccttgttggaaacttcatacaagcccactgtgcaccactaacacaaaggagggctcgaatatttgtttgacccgaacggatcgtgggtggtactgcgacaacgccggatctgtgtccttctttccccaggctgaaacctgtaaggttcagtcaaatagagtgttctgcgatacaatgaacagtagaactctgcctagcgaggtcaatctctgcaacgtggacatctttaatccaaaatatgattgtaagataatgacctccaaaacagacgtatctagctcagttattaccagtctgggtgccatcgtgtcctgctacggcaagactaaatgtacagcaagcaacaagtgcagggggatcattaagaccttctctaatggatgtgattatgtctcaaacaaaggcgtggacactgtcagtgtgggtaatacgctttactatgttaacaagcaagaggggaaaagcctgtacgtgaagggagaacccatcattaatttttatgaccctttggtattcccatccgatgagtttgacgcttctatatcgcaggtcaacgagaaaatcaaccagagcctcgccttcattcggaagtccgatgaactgttacacaatgtgaacgcgggcaagtcaacaaccaatatcatgatcactaccattataatcgttattatcgtgattctgctaagtctcatcgccgtcggcctgcttttgtactgcaaagcacgctctacaccggtgaccctgagcaaggaccagctctccgggataaacaatatcgctttctcaaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5555 - RNA, 1976 nt, synthetic construct
  misc_feature 1..1976: note = mRNA product Design f-2 comprising derived and/or modified sequence from HRSV(A2)__F_DSCav1_mut5 (opt4)
  source 1..1976: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5556 - RNA, 1976 nt, synthetic construct
  misc_feature 1..1976: note = mRNA product Design f-2 comprising derived and/or modified sequence from HRSV(A2)__F_DSCav1_mut5 (opt5)
  source 1..1976: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcggatgcggcgtttctgtgctgacatttaaggtccttgacctgaagaactacattgataaacaactcctgcctatcctgaataagcagtcctgtagcatttctaacatcgagaccgtgattgagttccagcagaaaaataaccggctcctggaaatcacgcgcgagttttccgtgaatgccggcgtcacaaccccggttagcacatatatgcttaccaactccgaactgctctctctgatcaatgacatgcccattaccaacgatcaaaagaaacttatgagcaacaatgtgcagatcgtgagacagcagtcctacagcattatgtgcatcattaaggaggaagtcctggcttatgtggttcaactccctctgtacggggtgatcgacacaccctgttggaaactgcatacgtctcctctctgcaccacaaacaccaaggagggatccaatatctgtctgacacggaccgatcgcggctggtactgcgacaacgccgggagcgtctctttctttccccaggcggaaacgtgtaaggtgcagagcaatagagttttctgcgatacaatgaactccagaaccctgccttctgaggtgaatctctgcaacgtcgacatttttaatccgaaatatgattgtaagatcatgaccagcaaaacagacgtgtccagctctgtcattacctccctgggagccatcgtgagctgctacggcaagacaaaatgtacggcttctaacaagtgccgggggattatcaagaccttctccaatggatgtgattatgttagcaacaaaggcgtggacacagtctccgtgggcaataccctttactatgttaacaagcaagaggggaaatctctgtacgtgaagggagaacccatcattaatttttatgaccctctcgtcttccccagcgatgagtttgacgcctccatctctcaggtgaacgagaaaattaaccagagcctggctttcatccgcaagtccgatgaactgctccacaatgtgaacgccggcaagagcacaaccaatattatgatcacgaccattatcatcgttattatcgtcattctgctttctctgatcgccgtggggctcctgctgtactgcaaagctagatccacacctgtgacccttagcaaggaccagctctctggaattaacaatatcgcgttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5557 - RNA, 1976 nt, synthetic construct
  misc_feature 1..1976: note = mRNA product Design f-2 comprising derived and/or modified sequence from HRSV(A2)__F_DSCav1_mut5 (opt6)
  source 1..1976: mol_type = other RNA
gggagagcggctcggccattttgtcccagtcagtccggaggctgcggctgcagaagtaccgcctgcggagtaactgcaaagaagcttaccatggaactattaatacttaaagccaacgcaataacaacaattctcactgctgtcaccttctgcttcgcctcaggccaaaacataacggaagaattttaccaatcaacatgctctgcagtatccaaaggctacctatctgctctaagaacaggttggtatacatcagtaataaccatagaactatcaaacataaaagaaaataaatgcaacggaacagacgcaaaagttaaactcataaaacaagaactagacaaatataaaaacgcagttaccgaactacaactacttatgcaatccactcccgccactggatcaggatcagcaatagcatcaggagtcgcagtatgtaaagtcttacacctcgaaggcgaagtcaataaaatcaaatccgcattactatccacaaacaaagcagtcgtatccctaagcggatgcggagtatcagtactaacatttaaagtactagacctaaaaaattacatcgataaacaactattacctatattaaacaaacaatcctgctccatttcaaatatcgaaaccgtaatagaatttcaacaaaaaaacaacagattactagaaataacaagagaattttccgtaaatgctggcgtaacaacaccagtatccacatacatgctcacaaactccgaactactatcactaataaatgacatgcccataacaaacgatcaaaaaaaactaatgtcaaataatgtacaaatagtaagacaacaaagctactccatcatgtgtataataaaagaagaagtactagcatacgtagttcaactaccactttacggcgtaatcgacaccccttgctggaaactacacacctcccctctatgcaccacaaacacaaaagaaggttccaacatatgccttaccagaacagacagaggctggtattgcgacaacgcaggatcagtttcattttttccacaagctgaaacatgcaaagtacaatcaaacagagtcttctgcgacacaatgaactcaagaactctaccctcagaagtaaacctatgtaacgtagacattttcaaccccaaatacgactgcaaaattatgacatcaaaaacagacgtttcatcatcagttatcacctcattaggagcaatagtaagctgctacggaaaaacaaaatgcaccgcctcaaataaatgcagaggaataataaaaactttctccaacggatgcgactacgtttcaaacaaaggtgtagacactgtatcagtaggaaacacactatattacgtaaataaacaagaaggaaaatcactttatgtcaaaggagaaccaataatcaatttctacgacccattagtattcccatcagacgaatttgatgcttcaatatcacaagtaaacgaaaaaataaatcaatcactcgcatttatacgaaaatcagacgaactactacacaatgtaaacgcaggcaaatcaacaacaaacataatgataacaacaataatcattgtaataatagtaatacttctatctctaatagcagtaggattactcctctactgcaaagcaagatcaacccctgtaacactatcaaaagaccaactttcaggtataaataatatagctttttccaattaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5558 - RNA, 1976 nt, synthetic construct
  misc_feature 1..1976: note = mRNA product Design f-2 comprising derived and/or modified sequence from HRSV(A2)__F_DSCav1_mut5 (opt11)
  source 1..1976: mol_type = other RNA
gggagagcggctcggccattttgtcccagtcagtccggaggctgcggctgcagaagtaccgcctgcggagtaactgcaaagaagcttaccatggagctcctaatcctcaaagccaacgcgatcactacaatcctcacagccgtcaccttctgcttcgcctccggccaaaacatcaccgaggagttctaccaatcaacctgctccgccgtatcaaaaggatacctaagcgccctacggaccggctggtacacatctgtcatcaccatcgaactatcaaacatcaaagaaaacaaatgcaacggaaccgacgcaaaagtcaaactgattaaacaagaactagacaaatacaaaaacgcagtcaccgaactgcaattactcatgcaaagcacaccggccaccggctcaggcagcgccatcgcctccggcgtcgccgtctgcaaagttctccacctcgagggcgaagtcaacaaaataaaatctgccctcctctccaccaacaaagccgtcgtctccctcagcggctgcggagtctccgtcctcaccttcaaagttctcgatctcaagaactatattgacaaacaacttctacccatactcaacaaacaaagctgcagcatatccaacatcgaaaccgtcatcgagttccaacaaaagaacaaccgcctcctcgaaataacccgcgagttcagcgttaacgccggagtcactacccctgtctccacctacatgctcaccaactccgaactcctatcactaatcaacgacatgcccataaccaacgaccagaagaaactcatgtccaacaacgtccaaattgtccgacaacaaagctactccataatgtgcataataaaagaggaagtcctcgcctacgtcgtacaactgcccctttatggcgtaatcgacacaccctgctggaaactccacacgtcacccctctgcaccaccaacacaaaagaaggctcgaacatctgcctaacacggactgaccgcggctggtactgcgacaacgccggctccgtcagcttcttcccacaagccgaaacctgcaaagtacaatccaaccgagtattctgcgacaccatgaactccagaaccctcccctcagaggtcaacctgtgcaacgtagacatcttcaaccccaaatacgactgcaaaataatgacctcaaaaacagacgtctcctcttccgtaatcaccagcctcggagccatcgtcagctgctacggcaaaaccaaatgcaccgcctcaaacaaatgccgcggcatcatcaaaacattctcaaacggctgcgactacgtctccaacaaaggcgtcgacacagtaagcgtaggcaacacactgtactacgtcaacaaacaagagggaaaatcactctacgtcaaaggagaacccataatcaacttctacgaccccctcgttttccccagcgacgagttcgacgccagcatatcccaagtcaacgagaaaattaaccaatccctagcattcatccgaaaatctgacgaactgctccacaacgtcaacgcgggaaaatcaacaaccaacataatgataaccacaatcataatagtcatcatcgtaatcctcctcagcctaatcgctgtcggcctcctcctctactgcaaagcccgttccaccccagtcacactttccaaggaccaactaagcggaataaacaacatcgcgttctcaaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5559 - RNA, 1967 nt, synthetic construct
  misc_feature 1..1967: note = mRNA product Design f-3 comprising derived and/or modified sequence from HRSV(A2)__F_DSCav1_mut5 (opt1)
  source 1..1967: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5560 - RNA, 1967 nt, synthetic construct
  misc_feature 1..1967: note = mRNA product Design f-3 comprising derived and/or modified sequence from HRSV(A2)__F_DSCav1_mut5 (opt1)
  source 1..1967: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcgggtgcggcgtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggggtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggcgtgatcgacacgccgtgctggaagctgcacaccagccccctctgcaccaccaacacgaaggaggggtccaacatctgcctgacccgcaccgaccggggctggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggggccatcgtgtcctgctacggcaagaccaagtgcaccgccagcaacaagtgccgggggatcatcaagaccttctccaacggctgcgactacgtgagcaacaagggcgtcgacacggtgagcgtggggaacaccctctactacgtcaacaagcaggagggcaagtccctgtacgtgaagggggagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccggcaagtccaccaccaacatcatgatcaccacgatcatcatcgtgatcatcgtcatcctcctgagcctgatcgccgtggggctcctgctgtactgcaaggcccggtccaccccggtgaccctgagcaaggaccagctctccggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5561 - RNA, 1967 nt, synthetic construct
  misc_feature 1..1967: note = mRNA product Design f-3 comprising derived and/or modified sequence from HRSV(A2)__F_DSCav1_mut5 (opt2)
  source 1..1967: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5562 - RNA, 1967 nt, synthetic construct
  misc_feature 1..1967: note = mRNA product Design f-3 comprising derived and/or modified sequence from HRSV(A2)__F_DSCav1_mut5 (opt3)
  source 1..1967: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcggttgcggggtgtccgtattaacttttaaggttctggaccttaagaactacattgataaacaattgctgcctatcctaaataagcagtcatgtagtattagcaacatcgagaccgtgatagagttccagcagaaaaataacaggctcctggaaattacacgggagttttctgtcaatgcgggagtgactaccccagtgtccacatatatgcttaccaactcagaactgttgagcctcatcaatgacatgccgattacgaacgatcaaaagaaactgatgagtaacaatgtccagatcgttcgccagcagtcttactccatcatgtgcattataaaggaggaagtgttagcatatgtagtgcaactgcccctctacggcgtcatcgacactccttgttggaaacttcatacaagcccactgtgcaccactaacacaaaggagggctcgaatatttgtttgacccgaacggatcgtgggtggtactgcgacaacgccggatctgtgtccttctttccccaggctgaaacctgtaaggttcagtcaaatagagtgttctgcgatacaatgaacagtagaactctgcctagcgaggtcaatctctgcaacgtggacatctttaatccaaaatatgattgtaagataatgacctccaaaacagacgtatctagctcagttattaccagtctgggtgccatcgtgtcctgctacggcaagactaaatgtacagcaagcaacaagtgcagggggatcattaagaccttctctaatggatgtgattatgtctcaaacaaaggcgtggacactgtcagtgtgggtaatacgctttactatgttaacaagcaagaggggaaaagcctgtacgtgaagggagaacccatcattaatttttatgaccctttggtattcccatccgatgagtttgacgcttctatatcgcaggtcaacgagaaaatcaaccagagcctcgccttcattcggaagtccgatgaactgttacacaatgtgaacgcgggcaagtcaacaaccaatatcatgatcactaccattataatcgttattatcgtgattctgctaagtctcatcgccgtcggcctgcttttgtactgcaaagcacgctctacaccggtgaccctgagcaaggaccagctctccgggataaacaatatcgctttctcaaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5563 - RNA, 1967 nt, synthetic construct
  misc_feature 1..1967: note = mRNA product Design f-3 comprising derived and/or modified sequence from HRSV(A2)__F_DSCav1_mut5 (opt4)
  source 1..1967: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5564 - RNA, 1967 nt, synthetic construct
  misc_feature 1..1967: note = mRNA product Design f-3 comprising derived and/or modified sequence from HRSV(A2)__F_DSCav1_mut5 (opt5)
  source 1..1967: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcggatgcggcgtttctgtgctgacatttaaggtccttgacctgaagaactacattgataaacaactcctgcctatcctgaataagcagtcctgtagcatttctaacatcgagaccgtgattgagttccagcagaaaaataaccggctcctggaaatcacgcgcgagttttccgtgaatgccggcgtcacaaccccggttagcacatatatgcttaccaactccgaactgctctctctgatcaatgacatgcccattaccaacgatcaaaagaaacttatgagcaacaatgtgcagatcgtgagacagcagtcctacagcattatgtgcatcattaaggaggaagtcctggcttatgtggttcaactccctctgtacggggtgatcgacacaccctgttggaaactgcatacgtctcctctctgcaccacaaacaccaaggagggatccaatatctgtctgacacggaccgatcgcggctggtactgcgacaacgccgggagcgtctctttctttccccaggcggaaacgtgtaaggtgcagagcaatagagttttctgcgatacaatgaactccagaaccctgccttctgaggtgaatctctgcaacgtcgacatttttaatccgaaatatgattgtaagatcatgaccagcaaaacagacgtgtccagctctgtcattacctccctgggagccatcgtgagctgctacggcaagacaaaatgtacggcttctaacaagtgccgggggattatcaagaccttctccaatggatgtgattatgttagcaacaaaggcgtggacacagtctccgtgggcaataccctttactatgttaacaagcaagaggggaaatctctgtacgtgaagggagaacccatcattaatttttatgaccctctcgtcttccccagcgatgagtttgacgcctccatctctcaggtgaacgagaaaattaaccagagcctggctttcatccgcaagtccgatgaactgctccacaatgtgaacgccggcaagagcacaaccaatattatgatcacgaccattatcatcgttattatcgtcattctgctttctctgatcgccgtggggctcctgctgtactgcaaagctagatccacacctgtgacccttagcaaggaccagctctctggaattaacaatatcgcgttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5565 - RNA, 1967 nt, synthetic construct
  misc_feature 1..1967: note = mRNA product Design f-3 comprising derived and/or modified sequence from HRSV(A2)__F_DSCav1_mut5 (opt6)
  source 1..1967: mol_type = other RNA
gggagagtcccgcagtcggcgtccagcggctctgcttgttcgtgtgtgtgtcgttgcaggccttattcaagcttaccatggaactattaatacttaaagccaacgcaataacaacaattctcactgctgtcaccttctgcttcgcctcaggccaaaacataacggaagaattttaccaatcaacatgctctgcagtatccaaaggctacctatctgctctaagaacaggttggtatacatcagtaataaccatagaactatcaaacataaaagaaaataaatgcaacggaacagacgcaaaagttaaactcataaaacaagaactagacaaatataaaaacgcagttaccgaactacaactacttatgcaatccactcccgccactggatcaggatcagcaatagcatcaggagtcgcagtatgtaaagtcttacacctcgaaggcgaagtcaataaaatcaaatccgcattactatccacaaacaaagcagtcgtatccctaagcggatgcggagtatcagtactaacatttaaagtactagacctaaaaaattacatcgataaacaactattacctatattaaacaaacaatcctgctccatttcaaatatcgaaaccgtaatagaatttcaacaaaaaaacaacagattactagaaataacaagagaattttccgtaaatgctggcgtaacaacaccagtatccacatacatgctcacaaactccgaactactatcactaataaatgacatgcccataacaaacgatcaaaaaaaactaatgtcaaataatgtacaaatagtaagacaacaaagctactccatcatgtgtataataaaagaagaagtactagcatacgtagttcaactaccactttacggcgtaatcgacaccccttgctggaaactacacacctcccctctatgcaccacaaacacaaaagaaggttccaacatatgccttaccagaacagacagaggctggtattgcgacaacgcaggatcagtttcattttttccacaagctgaaacatgcaaagtacaatcaaacagagtcttctgcgacacaatgaactcaagaactctaccctcagaagtaaacctatgtaacgtagacattttcaaccccaaatacgactgcaaaattatgacatcaaaaacagacgtttcatcatcagttatcacctcattaggagcaatagtaagctgctacggaaaaacaaaatgcaccgcctcaaataaatgcagaggaataataaaaactttctccaacggatgcgactacgtttcaaacaaaggtgtagacactgtatcagtaggaaacacactatattacgtaaataaacaagaaggaaaatcactttatgtcaaaggagaaccaataatcaatttctacgacccattagtattcccatcagacgaatttgatgcttcaatatcacaagtaaacgaaaaaataaatcaatcactcgcatttatacgaaaatcagacgaactactacacaatgtaaacgcaggcaaatcaacaacaaacataatgataacaacaataatcattgtaataatagtaatacttctatctctaatagcagtaggattactcctctactgcaaagcaagatcaacccctgtaacactatcaaaagaccaactttcaggtataaataatatagctttttccaattaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5566 - RNA, 1967 nt, synthetic construct
  misc_feature 1..1967: note = mRNA product Design f-3 comprising derived and/or modified sequence from HRSV(A2)__F_DSCav1_mut5 (opt11)
  source 1..1967: mol_type = other RNA
gggagagtcccgcagtcggcgtccagcggctctgcttgttcgtgtgtgtgtcgttgcaggccttattcaagcttaccatggagctcctaatcctcaaagccaacgcgatcactacaatcctcacagccgtcaccttctgcttcgcctccggccaaaacatcaccgaggagttctaccaatcaacctgctccgccgtatcaaaaggatacctaagcgccctacggaccggctggtacacatctgtcatcaccatcgaactatcaaacatcaaagaaaacaaatgcaacggaaccgacgcaaaagtcaaactgattaaacaagaactagacaaatacaaaaacgcagtcaccgaactgcaattactcatgcaaagcacaccggccaccggctcaggcagcgccatcgcctccggcgtcgccgtctgcaaagttctccacctcgagggcgaagtcaacaaaataaaatctgccctcctctccaccaacaaagccgtcgtctccctcagcggctgcggagtctccgtcctcaccttcaaagttctcgatctcaagaactatattgacaaacaacttctacccatactcaacaaacaaagctgcagcatatccaacatcgaaaccgtcatcgagttccaacaaaagaacaaccgcctcctcgaaataacccgcgagttcagcgttaacgccggagtcactacccctgtctccacctacatgctcaccaactccgaactcctatcactaatcaacgacatgcccataaccaacgaccagaagaaactcatgtccaacaacgtccaaattgtccgacaacaaagctactccataatgtgcataataaaagaggaagtcctcgcctacgtcgtacaactgcccctttatggcgtaatcgacacaccctgctggaaactccacacgtcacccctctgcaccaccaacacaaaagaaggctcgaacatctgcctaacacggactgaccgcggctggtactgcgacaacgccggctccgtcagcttcttcccacaagccgaaacctgcaaagtacaatccaaccgagtattctgcgacaccatgaactccagaaccctcccctcagaggtcaacctgtgcaacgtagacatcttcaaccccaaatacgactgcaaaataatgacctcaaaaacagacgtctcctcttccgtaatcaccagcctcggagccatcgtcagctgctacggcaaaaccaaatgcaccgcctcaaacaaatgccgcggcatcatcaaaacattctcaaacggctgcgactacgtctccaacaaaggcgtcgacacagtaagcgtaggcaacacactgtactacgtcaacaaacaagagggaaaatcactctacgtcaaaggagaacccataatcaacttctacgaccccctcgttttccccagcgacgagttcgacgccagcatatcccaagtcaacgagaaaattaaccaatccctagcattcatccgaaaatctgacgaactgctccacaacgtcaacgcgggaaaatcaacaaccaacataatgataaccacaatcataatagtcatcatcgtaatcctcctcagcctaatcgctgtcggcctcctcctctactgcaaagcccgttccaccccagtcacactttccaaggaccaactaagcggaataaacaacatcgcgttctcaaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5567 - RNA, 2183 nt, synthetic construct
  misc_feature 1..2183: note = mRNA product Design f-4 comprising derived and/or modified sequence from HRSV(A2)__F_DSCav1_mut5 (opt1)
  source 1..2183: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5568 - RNA, 2183 nt, synthetic construct
  misc_feature 1..2183: note = mRNA product Design f-4 comprising derived and/or modified sequence from HRSV(A2)__F_DSCav1_mut5 (opt1)
  source 1..2183: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcgggtgcggcgtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggggtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggcgtgatcgacacgccgtgctggaagctgcacaccagccccctctgcaccaccaacacgaaggaggggtccaacatctgcctgacccgcaccgaccggggctggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggggccatcgtgtcctgctacggcaagaccaagtgcaccgccagcaacaagtgccgggggatcatcaagaccttctccaacggctgcgactacgtgagcaacaagggcgtcgacacggtgagcgtggggaacaccctctactacgtcaacaagcaggagggcaagtccctgtacgtgaagggggagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccggcaagtccaccaccaacatcatgatcaccacgatcatcatcgtgatcatcgtcatcctcctgagcctgatcgccgtggggctcctgctgtactgcaaggcccggtccaccccggtgaccctgagcaaggaccagctctccggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5569 - RNA, 2183 nt, synthetic construct
  misc_feature 1..2183: note = mRNA product Design f-4 comprising derived and/or modified sequence from HRSV(A2)__F_DSCav1_mut5 (opt2)
  source 1..2183: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5570 - RNA, 2183 nt, synthetic construct
  misc_feature 1..2183: note = mRNA product Design f-4 comprising derived and/or modified sequence from HRSV(A2)__F_DSCav1_mut5 (opt3)
  source 1..2183: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcggttgcggggtgtccgtattaacttttaaggttctggaccttaagaactacattgataaacaattgctgcctatcctaaataagcagtcatgtagtattagcaacatcgagaccgtgatagagttccagcagaaaaataacaggctcctggaaattacacgggagttttctgtcaatgcgggagtgactaccccagtgtccacatatatgcttaccaactcagaactgttgagcctcatcaatgacatgccgattacgaacgatcaaaagaaactgatgagtaacaatgtccagatcgttcgccagcagtcttactccatcatgtgcattataaaggaggaagtgttagcatatgtagtgcaactgcccctctacggcgtcatcgacactccttgttggaaacttcatacaagcccactgtgcaccactaacacaaaggagggctcgaatatttgtttgacccgaacggatcgtgggtggtactgcgacaacgccggatctgtgtccttctttccccaggctgaaacctgtaaggttcagtcaaatagagtgttctgcgatacaatgaacagtagaactctgcctagcgaggtcaatctctgcaacgtggacatctttaatccaaaatatgattgtaagataatgacctccaaaacagacgtatctagctcagttattaccagtctgggtgccatcgtgtcctgctacggcaagactaaatgtacagcaagcaacaagtgcagggggatcattaagaccttctctaatggatgtgattatgtctcaaacaaaggcgtggacactgtcagtgtgggtaatacgctttactatgttaacaagcaagaggggaaaagcctgtacgtgaagggagaacccatcattaatttttatgaccctttggtattcccatccgatgagtttgacgcttctatatcgcaggtcaacgagaaaatcaaccagagcctcgccttcattcggaagtccgatgaactgttacacaatgtgaacgcgggcaagtcaacaaccaatatcatgatcactaccattataatcgttattatcgtgattctgctaagtctcatcgccgtcggcctgcttttgtactgcaaagcacgctctacaccggtgaccctgagcaaggaccagctctccgggataaacaatatcgctttctcaaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5571 - RNA, 2183 nt, synthetic construct
  misc_feature 1..2183: note = mRNA product Design f-4 comprising derived and/or modified sequence from HRSV(A2)__F_DSCav1_mut5 (opt4)
  source 1..2183: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5572 - RNA, 2183 nt, synthetic construct
  misc_feature 1..2183: note = mRNA product Design f-4 comprising derived and/or modified sequence from HRSV(A2)__F_DSCav1_mut5 (opt5)
  source 1..2183: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcggatgcggcgtttctgtgctgacatttaaggtccttgacctgaagaactacattgataaacaactcctgcctatcctgaataagcagtcctgtagcatttctaacatcgagaccgtgattgagttccagcagaaaaataaccggctcctggaaatcacgcgcgagttttccgtgaatgccggcgtcacaaccccggttagcacatatatgcttaccaactccgaactgctctctctgatcaatgacatgcccattaccaacgatcaaaagaaacttatgagcaacaatgtgcagatcgtgagacagcagtcctacagcattatgtgcatcattaaggaggaagtcctggcttatgtggttcaactccctctgtacggggtgatcgacacaccctgttggaaactgcatacgtctcctctctgcaccacaaacaccaaggagggatccaatatctgtctgacacggaccgatcgcggctggtactgcgacaacgccgggagcgtctctttctttccccaggcggaaacgtgtaaggtgcagagcaatagagttttctgcgatacaatgaactccagaaccctgccttctgaggtgaatctctgcaacgtcgacatttttaatccgaaatatgattgtaagatcatgaccagcaaaacagacgtgtccagctctgtcattacctccctgggagccatcgtgagctgctacggcaagacaaaatgtacggcttctaacaagtgccgggggattatcaagaccttctccaatggatgtgattatgttagcaacaaaggcgtggacacagtctccgtgggcaataccctttactatgttaacaagcaagaggggaaatctctgtacgtgaagggagaacccatcattaatttttatgaccctctcgtcttccccagcgatgagtttgacgcctccatctctcaggtgaacgagaaaattaaccagagcctggctttcatccgcaagtccgatgaactgctccacaatgtgaacgccggcaagagcacaaccaatattatgatcacgaccattatcatcgttattatcgtcattctgctttctctgatcgccgtggggctcctgctgtactgcaaagctagatccacacctgtgacccttagcaaggaccagctctctggaattaacaatatcgcgttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5573 - RNA, 2183 nt, synthetic construct
  misc_feature 1..2183: note = mRNA product Design f-4 comprising derived and/or modified sequence from HRSV(A2)__F_DSCav1_mut5 (opt6)
  source 1..2183: mol_type = other RNA
gggagagtcccgcagtcggcgtccagcggctctgcttgttcgtgtgtgtgtcgttgcaggccttattcaagcttaccatggaactattaatacttaaagccaacgcaataacaacaattctcactgctgtcaccttctgcttcgcctcaggccaaaacataacggaagaattttaccaatcaacatgctctgcagtatccaaaggctacctatctgctctaagaacaggttggtatacatcagtaataaccatagaactatcaaacataaaagaaaataaatgcaacggaacagacgcaaaagttaaactcataaaacaagaactagacaaatataaaaacgcagttaccgaactacaactacttatgcaatccactcccgccactggatcaggatcagcaatagcatcaggagtcgcagtatgtaaagtcttacacctcgaaggcgaagtcaataaaatcaaatccgcattactatccacaaacaaagcagtcgtatccctaagcggatgcggagtatcagtactaacatttaaagtactagacctaaaaaattacatcgataaacaactattacctatattaaacaaacaatcctgctccatttcaaatatcgaaaccgtaatagaatttcaacaaaaaaacaacagattactagaaataacaagagaattttccgtaaatgctggcgtaacaacaccagtatccacatacatgctcacaaactccgaactactatcactaataaatgacatgcccataacaaacgatcaaaaaaaactaatgtcaaataatgtacaaatagtaagacaacaaagctactccatcatgtgtataataaaagaagaagtactagcatacgtagttcaactaccactttacggcgtaatcgacaccccttgctggaaactacacacctcccctctatgcaccacaaacacaaaagaaggttccaacatatgccttaccagaacagacagaggctggtattgcgacaacgcaggatcagtttcattttttccacaagctgaaacatgcaaagtacaatcaaacagagtcttctgcgacacaatgaactcaagaactctaccctcagaagtaaacctatgtaacgtagacattttcaaccccaaatacgactgcaaaattatgacatcaaaaacagacgtttcatcatcagttatcacctcattaggagcaatagtaagctgctacggaaaaacaaaatgcaccgcctcaaataaatgcagaggaataataaaaactttctccaacggatgcgactacgtttcaaacaaaggtgtagacactgtatcagtaggaaacacactatattacgtaaataaacaagaaggaaaatcactttatgtcaaaggagaaccaataatcaatttctacgacccattagtattcccatcagacgaatttgatgcttcaatatcacaagtaaacgaaaaaataaatcaatcactcgcatttatacgaaaatcagacgaactactacacaatgtaaacgcaggcaaatcaacaacaaacataatgataacaacaataatcattgtaataatagtaatacttctatctctaatagcagtaggattactcctctactgcaaagcaagatcaacccctgtaacactatcaaaagaccaactttcaggtataaataatatagctttttccaattaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5574 - RNA, 2183 nt, synthetic construct
  misc_feature 1..2183: note = mRNA product Design f-4 comprising derived and/or modified sequence from HRSV(A2)__F_DSCav1_mut5 (opt11)
  source 1..2183: mol_type = other RNA
gggagagtcccgcagtcggcgtccagcggctctgcttgttcgtgtgtgtgtcgttgcaggccttattcaagcttaccatggagctcctaatcctcaaagccaacgcgatcactacaatcctcacagccgtcaccttctgcttcgcctccggccaaaacatcaccgaggagttctaccaatcaacctgctccgccgtatcaaaaggatacctaagcgccctacggaccggctggtacacatctgtcatcaccatcgaactatcaaacatcaaagaaaacaaatgcaacggaaccgacgcaaaagtcaaactgattaaacaagaactagacaaatacaaaaacgcagtcaccgaactgcaattactcatgcaaagcacaccggccaccggctcaggcagcgccatcgcctccggcgtcgccgtctgcaaagttctccacctcgagggcgaagtcaacaaaataaaatctgccctcctctccaccaacaaagccgtcgtctccctcagcggctgcggagtctccgtcctcaccttcaaagttctcgatctcaagaactatattgacaaacaacttctacccatactcaacaaacaaagctgcagcatatccaacatcgaaaccgtcatcgagttccaacaaaagaacaaccgcctcctcgaaataacccgcgagttcagcgttaacgccggagtcactacccctgtctccacctacatgctcaccaactccgaactcctatcactaatcaacgacatgcccataaccaacgaccagaagaaactcatgtccaacaacgtccaaattgtccgacaacaaagctactccataatgtgcataataaaagaggaagtcctcgcctacgtcgtacaactgcccctttatggcgtaatcgacacaccctgctggaaactccacacgtcacccctctgcaccaccaacacaaaagaaggctcgaacatctgcctaacacggactgaccgcggctggtactgcgacaacgccggctccgtcagcttcttcccacaagccgaaacctgcaaagtacaatccaaccgagtattctgcgacaccatgaactccagaaccctcccctcagaggtcaacctgtgcaacgtagacatcttcaaccccaaatacgactgcaaaataatgacctcaaaaacagacgtctcctcttccgtaatcaccagcctcggagccatcgtcagctgctacggcaaaaccaaatgcaccgcctcaaacaaatgccgcggcatcatcaaaacattctcaaacggctgcgactacgtctccaacaaaggcgtcgacacagtaagcgtaggcaacacactgtactacgtcaacaaacaagagggaaaatcactctacgtcaaaggagaacccataatcaacttctacgaccccctcgttttccccagcgacgagttcgacgccagcatatcccaagtcaacgagaaaattaaccaatccctagcattcatccgaaaatctgacgaactgctccacaacgtcaacgcgggaaaatcaacaaccaacataatgataaccacaatcataatagtcatcatcgtaatcctcctcagcctaatcgctgtcggcctcctcctctactgcaaagcccgttccaccccagtcacactttccaaggaccaactaagcggaataaacaacatcgcgttctcaaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5575 - RNA, 1959 nt, synthetic construct
  misc_feature 1..1959: note = mRNA product Design f-5 comprising derived and/or modified sequence from HRSV(A2)__F_DSCav1_mut5 (opt1)
  source 1..1959: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5576 - RNA, 1959 nt, synthetic construct
  misc_feature 1..1959: note = mRNA product Design f-5 comprising derived and/or modified sequence from HRSV(A2)__F_DSCav1_mut5 (opt1)
  source 1..1959: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcgggtgcggcgtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggggtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggcgtgatcgacacgccgtgctggaagctgcacaccagccccctctgcaccaccaacacgaaggaggggtccaacatctgcctgacccgcaccgaccggggctggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggggccatcgtgtcctgctacggcaagaccaagtgcaccgccagcaacaagtgccgggggatcatcaagaccttctccaacggctgcgactacgtgagcaacaagggcgtcgacacggtgagcgtggggaacaccctctactacgtcaacaagcaggagggcaagtccctgtacgtgaagggggagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccggcaagtccaccaccaacatcatgatcaccacgatcatcatcgtgatcatcgtcatcctcctgagcctgatcgccgtggggctcctgctgtactgcaaggcccggtccaccccggtgaccctgagcaaggaccagctctccggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5577 - RNA, 1959 nt, synthetic construct
  misc_feature 1..1959: note = mRNA product Design f-5 comprising derived and/or modified sequence from HRSV(A2)__F_DSCav1_mut5 (opt2)
  source 1..1959: mol_type = other RNA
gggagactttcccattctgtagcagaatttggtgttgcctgtggtcttggtcccgcggagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5578 - RNA, 1959 nt, synthetic construct
  misc_feature 1..1959: note = mRNA product Design f-5 comprising derived and/or modified sequence from HRSV(A2)__F_DSCav1_mut5 (opt3)
  source 1..1959: mol_type = other RNA
gggagactttcccattctgtagcagaatttggtgttgcctgtggtcttggtcccgcggagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcggttgcggggtgtccgtattaacttttaaggttctggaccttaagaactacattgataaacaattgctgcctatcctaaataagcagtcatgtagtattagcaacatcgagaccgtgatagagttccagcagaaaaataacaggctcctggaaattacacgggagttttctgtcaatgcgggagtgactaccccagtgtccacatatatgcttaccaactcagaactgttgagcctcatcaatgacatgccgattacgaacgatcaaaagaaactgatgagtaacaatgtccagatcgttcgccagcagtcttactccatcatgtgcattataaaggaggaagtgttagcatatgtagtgcaactgcccctctacggcgtcatcgacactccttgttggaaacttcatacaagcccactgtgcaccactaacacaaaggagggctcgaatatttgtttgacccgaacggatcgtgggtggtactgcgacaacgccggatctgtgtccttctttccccaggctgaaacctgtaaggttcagtcaaatagagtgttctgcgatacaatgaacagtagaactctgcctagcgaggtcaatctctgcaacgtggacatctttaatccaaaatatgattgtaagataatgacctccaaaacagacgtatctagctcagttattaccagtctgggtgccatcgtgtcctgctacggcaagactaaatgtacagcaagcaacaagtgcagggggatcattaagaccttctctaatggatgtgattatgtctcaaacaaaggcgtggacactgtcagtgtgggtaatacgctttactatgttaacaagcaagaggggaaaagcctgtacgtgaagggagaacccatcattaatttttatgaccctttggtattcccatccgatgagtttgacgcttctatatcgcaggtcaacgagaaaatcaaccagagcctcgccttcattcggaagtccgatgaactgttacacaatgtgaacgcgggcaagtcaacaaccaatatcatgatcactaccattataatcgttattatcgtgattctgctaagtctcatcgccgtcggcctgcttttgtactgcaaagcacgctctacaccggtgaccctgagcaaggaccagctctccgggataaacaatatcgctttctcaaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5579 - RNA, 1959 nt, synthetic construct
  misc_feature 1..1959: note = mRNA product Design f-5 comprising derived and/or modified sequence from HRSV(A2)__F_DSCav1_mut5 (opt4)
  source 1..1959: mol_type = other RNA
gggagactttcccattctgtagcagaatttggtgttgcctgtggtcttggtcccgcggagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5580 - RNA, 1959 nt, synthetic construct
  misc_feature 1..1959: note = mRNA product Design f-5 comprising derived and/or modified sequence from HRSV(A2)__F_DSCav1_mut5 (opt5)
  source 1..1959: mol_type = other RNA
gggagactttcccattctgtagcagaatttggtgttgcctgtggtcttggtcccgcggagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcggatgcggcgtttctgtgctgacatttaaggtccttgacctgaagaactacattgataaacaactcctgcctatcctgaataagcagtcctgtagcatttctaacatcgagaccgtgattgagttccagcagaaaaataaccggctcctggaaatcacgcgcgagttttccgtgaatgccggcgtcacaaccccggttagcacatatatgcttaccaactccgaactgctctctctgatcaatgacatgcccattaccaacgatcaaaagaaacttatgagcaacaatgtgcagatcgtgagacagcagtcctacagcattatgtgcatcattaaggaggaagtcctggcttatgtggttcaactccctctgtacggggtgatcgacacaccctgttggaaactgcatacgtctcctctctgcaccacaaacaccaaggagggatccaatatctgtctgacacggaccgatcgcggctggtactgcgacaacgccgggagcgtctctttctttccccaggcggaaacgtgtaaggtgcagagcaatagagttttctgcgatacaatgaactccagaaccctgccttctgaggtgaatctctgcaacgtcgacatttttaatccgaaatatgattgtaagatcatgaccagcaaaacagacgtgtccagctctgtcattacctccctgggagccatcgtgagctgctacggcaagacaaaatgtacggcttctaacaagtgccgggggattatcaagaccttctccaatggatgtgattatgttagcaacaaaggcgtggacacagtctccgtgggcaataccctttactatgttaacaagcaagaggggaaatctctgtacgtgaagggagaacccatcattaatttttatgaccctctcgtcttccccagcgatgagtttgacgcctccatctctcaggtgaacgagaaaattaaccagagcctggctttcatccgcaagtccgatgaactgctccacaatgtgaacgccggcaagagcacaaccaatattatgatcacgaccattatcatcgttattatcgtcattctgctttctctgatcgccgtggggctcctgctgtactgcaaagctagatccacacctgtgacccttagcaaggaccagctctctggaattaacaatatcgcgttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5581 - RNA, 1959 nt, synthetic construct
  misc_feature 1..1959: note = mRNA product Design f-5 comprising derived and/or modified sequence from HRSV(A2)__F_DSCav1_mut5 (opt6)
  source 1..1959: mol_type = other RNA
gggagactttcccattctgtagcagaatttggtgttgcctgtggtcttggtcccgcggagaagcttaccatggaactattaatacttaaagccaacgcaataacaacaattctcactgctgtcaccttctgcttcgcctcaggccaaaacataacggaagaattttaccaatcaacatgctctgcagtatccaaaggctacctatctgctctaagaacaggttggtatacatcagtaataaccatagaactatcaaacataaaagaaaataaatgcaacggaacagacgcaaaagttaaactcataaaacaagaactagacaaatataaaaacgcagttaccgaactacaactacttatgcaatccactcccgccactggatcaggatcagcaatagcatcaggagtcgcagtatgtaaagtcttacacctcgaaggcgaagtcaataaaatcaaatccgcattactatccacaaacaaagcagtcgtatccctaagcggatgcggagtatcagtactaacatttaaagtactagacctaaaaaattacatcgataaacaactattacctatattaaacaaacaatcctgctccatttcaaatatcgaaaccgtaatagaatttcaacaaaaaaacaacagattactagaaataacaagagaattttccgtaaatgctggcgtaacaacaccagtatccacatacatgctcacaaactccgaactactatcactaataaatgacatgcccataacaaacgatcaaaaaaaactaatgtcaaataatgtacaaatagtaagacaacaaagctactccatcatgtgtataataaaagaagaagtactagcatacgtagttcaactaccactttacggcgtaatcgacaccccttgctggaaactacacacctcccctctatgcaccacaaacacaaaagaaggttccaacatatgccttaccagaacagacagaggctggtattgcgacaacgcaggatcagtttcattttttccacaagctgaaacatgcaaagtacaatcaaacagagtcttctgcgacacaatgaactcaagaactctaccctcagaagtaaacctatgtaacgtagacattttcaaccccaaatacgactgcaaaattatgacatcaaaaacagacgtttcatcatcagttatcacctcattaggagcaatagtaagctgctacggaaaaacaaaatgcaccgcctcaaataaatgcagaggaataataaaaactttctccaacggatgcgactacgtttcaaacaaaggtgtagacactgtatcagtaggaaacacactatattacgtaaataaacaagaaggaaaatcactttatgtcaaaggagaaccaataatcaatttctacgacccattagtattcccatcagacgaatttgatgcttcaatatcacaagtaaacgaaaaaataaatcaatcactcgcatttatacgaaaatcagacgaactactacacaatgtaaacgcaggcaaatcaacaacaaacataatgataacaacaataatcattgtaataatagtaatacttctatctctaatagcagtaggattactcctctactgcaaagcaagatcaacccctgtaacactatcaaaagaccaactttcaggtataaataatatagctttttccaattaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5582 - RNA, 1959 nt, synthetic construct
  misc_feature 1..1959: note = mRNA product Design f-5 comprising derived and/or modified sequence from HRSV(A2)__F_DSCav1_mut5 (opt11)
  source 1..1959: mol_type = other RNA
gggagactttcccattctgtagcagaatttggtgttgcctgtggtcttggtcccgcggagaagcttaccatggagctcctaatcctcaaagccaacgcgatcactacaatcctcacagccgtcaccttctgcttcgcctccggccaaaacatcaccgaggagttctaccaatcaacctgctccgccgtatcaaaaggatacctaagcgccctacggaccggctggtacacatctgtcatcaccatcgaactatcaaacatcaaagaaaacaaatgcaacggaaccgacgcaaaagtcaaactgattaaacaagaactagacaaatacaaaaacgcagtcaccgaactgcaattactcatgcaaagcacaccggccaccggctcaggcagcgccatcgcctccggcgtcgccgtctgcaaagttctccacctcgagggcgaagtcaacaaaataaaatctgccctcctctccaccaacaaagccgtcgtctccctcagcggctgcggagtctccgtcctcaccttcaaagttctcgatctcaagaactatattgacaaacaacttctacccatactcaacaaacaaagctgcagcatatccaacatcgaaaccgtcatcgagttccaacaaaagaacaaccgcctcctcgaaataacccgcgagttcagcgttaacgccggagtcactacccctgtctccacctacatgctcaccaactccgaactcctatcactaatcaacgacatgcccataaccaacgaccagaagaaactcatgtccaacaacgtccaaattgtccgacaacaaagctactccataatgtgcataataaaagaggaagtcctcgcctacgtcgtacaactgcccctttatggcgtaatcgacacaccctgctggaaactccacacgtcacccctctgcaccaccaacacaaaagaaggctcgaacatctgcctaacacggactgaccgcggctggtactgcgacaacgccggctccgtcagcttcttcccacaagccgaaacctgcaaagtacaatccaaccgagtattctgcgacaccatgaactccagaaccctcccctcagaggtcaacctgtgcaacgtagacatcttcaaccccaaatacgactgcaaaataatgacctcaaaaacagacgtctcctcttccgtaatcaccagcctcggagccatcgtcagctgctacggcaaaaccaaatgcaccgcctcaaacaaatgccgcggcatcatcaaaacattctcaaacggctgcgactacgtctccaacaaaggcgtcgacacagtaagcgtaggcaacacactgtactacgtcaacaaacaagagggaaaatcactctacgtcaaaggagaacccataatcaacttctacgaccccctcgttttccccagcgacgagttcgacgccagcatatcccaagtcaacgagaaaattaaccaatccctagcattcatccgaaaatctgacgaactgctccacaacgtcaacgcgggaaaatcaacaaccaacataatgataaccacaatcataatagtcatcatcgtaatcctcctcagcctaatcgctgtcggcctcctcctctactgcaaagcccgttccaccccagtcacactttccaaggaccaactaagcggaataaacaacatcgcgttctcaaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5583 - RNA, 1955 nt, synthetic construct
  misc_feature 1..1955: note = mRNA product Design g-1 comprising derived and/or modified sequence from HRSV(A2)__F_DSCav1_mut5 (opt1)
  source 1..1955: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5584 - RNA, 1955 nt, synthetic construct
  misc_feature 1..1955: note = mRNA product Design g-1 comprising derived and/or modified sequence from HRSV(A2)__F_DSCav1_mut5 (opt1)
  source 1..1955: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcgggtgcggcgtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggggtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggcgtgatcgacacgccgtgctggaagctgcacaccagccccctctgcaccaccaacacgaaggaggggtccaacatctgcctgacccgcaccgaccggggctggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggggccatcgtgtcctgctacggcaagaccaagtgcaccgccagcaacaagtgccgggggatcatcaagaccttctccaacggctgcgactacgtgagcaacaagggcgtcgacacggtgagcgtggggaacaccctctactacgtcaacaagcaggagggcaagtccctgtacgtgaagggggagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccggcaagtccaccaccaacatcatgatcaccacgatcatcatcgtgatcatcgtcatcctcctgagcctgatcgccgtggggctcctgctgtactgcaaggcccggtccaccccggtgaccctgagcaaggaccagctctccggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5585 - RNA, 1955 nt, synthetic construct
  misc_feature 1..1955: note = mRNA product Design g-1 comprising derived and/or modified sequence from HRSV(A2)__F_DSCav1_mut5 (opt2)
  source 1..1955: mol_type = other RNA
gggagactttcccattctgtagcagaatttggtgttgcctgtggtcttggtcccgcggagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5586 - RNA, 1955 nt, synthetic construct
  misc_feature 1..1955: note = mRNA product Design g-1 comprising derived and/or modified sequence from HRSV(A2)__F_DSCav1_mut5 (opt3)
  source 1..1955: mol_type = other RNA
gggagactttcccattctgtagcagaatttggtgttgcctgtggtcttggtcccgcggagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcggttgcggggtgtccgtattaacttttaaggttctggaccttaagaactacattgataaacaattgctgcctatcctaaataagcagtcatgtagtattagcaacatcgagaccgtgatagagttccagcagaaaaataacaggctcctggaaattacacgggagttttctgtcaatgcgggagtgactaccccagtgtccacatatatgcttaccaactcagaactgttgagcctcatcaatgacatgccgattacgaacgatcaaaagaaactgatgagtaacaatgtccagatcgttcgccagcagtcttactccatcatgtgcattataaaggaggaagtgttagcatatgtagtgcaactgcccctctacggcgtcatcgacactccttgttggaaacttcatacaagcccactgtgcaccactaacacaaaggagggctcgaatatttgtttgacccgaacggatcgtgggtggtactgcgacaacgccggatctgtgtccttctttccccaggctgaaacctgtaaggttcagtcaaatagagtgttctgcgatacaatgaacagtagaactctgcctagcgaggtcaatctctgcaacgtggacatctttaatccaaaatatgattgtaagataatgacctccaaaacagacgtatctagctcagttattaccagtctgggtgccatcgtgtcctgctacggcaagactaaatgtacagcaagcaacaagtgcagggggatcattaagaccttctctaatggatgtgattatgtctcaaacaaaggcgtggacactgtcagtgtgggtaatacgctttactatgttaacaagcaagaggggaaaagcctgtacgtgaagggagaacccatcattaatttttatgaccctttggtattcccatccgatgagtttgacgcttctatatcgcaggtcaacgagaaaatcaaccagagcctcgccttcattcggaagtccgatgaactgttacacaatgtgaacgcgggcaagtcaacaaccaatatcatgatcactaccattataatcgttattatcgtgattctgctaagtctcatcgccgtcggcctgcttttgtactgcaaagcacgctctacaccggtgaccctgagcaaggaccagctctccgggataaacaatatcgctttctcaaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5587 - RNA, 1955 nt, synthetic construct
  misc_feature 1..1955: note = mRNA product Design g-1 comprising derived and/or modified sequence from HRSV(A2)__F_DSCav1_mut5 (opt4)
  source 1..1955: mol_type = other RNA
gggagactttcccattctgtagcagaatttggtgttgcctgtggtcttggtcccgcggagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5588 - RNA, 1955 nt, synthetic construct
  misc_feature 1..1955: note = mRNA product Design g-1 comprising derived and/or modified sequence from HRSV(A2)__F_DSCav1_mut5 (opt5)
  source 1..1955: mol_type = other RNA
gggagactttcccattctgtagcagaatttggtgttgcctgtggtcttggtcccgcggagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcggatgcggcgtttctgtgctgacatttaaggtccttgacctgaagaactacattgataaacaactcctgcctatcctgaataagcagtcctgtagcatttctaacatcgagaccgtgattgagttccagcagaaaaataaccggctcctggaaatcacgcgcgagttttccgtgaatgccggcgtcacaaccccggttagcacatatatgcttaccaactccgaactgctctctctgatcaatgacatgcccattaccaacgatcaaaagaaacttatgagcaacaatgtgcagatcgtgagacagcagtcctacagcattatgtgcatcattaaggaggaagtcctggcttatgtggttcaactccctctgtacggggtgatcgacacaccctgttggaaactgcatacgtctcctctctgcaccacaaacaccaaggagggatccaatatctgtctgacacggaccgatcgcggctggtactgcgacaacgccgggagcgtctctttctttccccaggcggaaacgtgtaaggtgcagagcaatagagttttctgcgatacaatgaactccagaaccctgccttctgaggtgaatctctgcaacgtcgacatttttaatccgaaatatgattgtaagatcatgaccagcaaaacagacgtgtccagctctgtcattacctccctgggagccatcgtgagctgctacggcaagacaaaatgtacggcttctaacaagtgccgggggattatcaagaccttctccaatggatgtgattatgttagcaacaaaggcgtggacacagtctccgtgggcaataccctttactatgttaacaagcaagaggggaaatctctgtacgtgaagggagaacccatcattaatttttatgaccctctcgtcttccccagcgatgagtttgacgcctccatctctcaggtgaacgagaaaattaaccagagcctggctttcatccgcaagtccgatgaactgctccacaatgtgaacgccggcaagagcacaaccaatattatgatcacgaccattatcatcgttattatcgtcattctgctttctctgatcgccgtggggctcctgctgtactgcaaagctagatccacacctgtgacccttagcaaggaccagctctctggaattaacaatatcgcgttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5589 - RNA, 1955 nt, synthetic construct
  misc_feature 1..1955: note = mRNA product Design g-1 comprising derived and/or modified sequence from HRSV(A2)__F_DSCav1_mut5 (opt6)
  source 1..1955: mol_type = other RNA
gggagactttcccattctgtagcagaatttggtgttgcctgtggtcttggtcccgcggagaagcttaccatggaactattaatacttaaagccaacgcaataacaacaattctcactgctgtcaccttctgcttcgcctcaggccaaaacataacggaagaattttaccaatcaacatgctctgcagtatccaaaggctacctatctgctctaagaacaggttggtatacatcagtaataaccatagaactatcaaacataaaagaaaataaatgcaacggaacagacgcaaaagttaaactcataaaacaagaactagacaaatataaaaacgcagttaccgaactacaactacttatgcaatccactcccgccactggatcaggatcagcaatagcatcaggagtcgcagtatgtaaagtcttacacctcgaaggcgaagtcaataaaatcaaatccgcattactatccacaaacaaagcagtcgtatccctaagcggatgcggagtatcagtactaacatttaaagtactagacctaaaaaattacatcgataaacaactattacctatattaaacaaacaatcctgctccatttcaaatatcgaaaccgtaatagaatttcaacaaaaaaacaacagattactagaaataacaagagaattttccgtaaatgctggcgtaacaacaccagtatccacatacatgctcacaaactccgaactactatcactaataaatgacatgcccataacaaacgatcaaaaaaaactaatgtcaaataatgtacaaatagtaagacaacaaagctactccatcatgtgtataataaaagaagaagtactagcatacgtagttcaactaccactttacggcgtaatcgacaccccttgctggaaactacacacctcccctctatgcaccacaaacacaaaagaaggttccaacatatgccttaccagaacagacagaggctggtattgcgacaacgcaggatcagtttcattttttccacaagctgaaacatgcaaagtacaatcaaacagagtcttctgcgacacaatgaactcaagaactctaccctcagaagtaaacctatgtaacgtagacattttcaaccccaaatacgactgcaaaattatgacatcaaaaacagacgtttcatcatcagttatcacctcattaggagcaatagtaagctgctacggaaaaacaaaatgcaccgcctcaaataaatgcagaggaataataaaaactttctccaacggatgcgactacgtttcaaacaaaggtgtagacactgtatcagtaggaaacacactatattacgtaaataaacaagaaggaaaatcactttatgtcaaaggagaaccaataatcaatttctacgacccattagtattcccatcagacgaatttgatgcttcaatatcacaagtaaacgaaaaaataaatcaatcactcgcatttatacgaaaatcagacgaactactacacaatgtaaacgcaggcaaatcaacaacaaacataatgataacaacaataatcattgtaataatagtaatacttctatctctaatagcagtaggattactcctctactgcaaagcaagatcaacccctgtaacactatcaaaagaccaactttcaggtataaataatatagctttttccaattaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5590 - RNA, 1955 nt, synthetic construct
  misc_feature 1..1955: note = mRNA product Design g-1 comprising derived and/or modified sequence from HRSV(A2)__F_DSCav1_mut5 (opt11)
  source 1..1955: mol_type = other RNA
gggagactttcccattctgtagcagaatttggtgttgcctgtggtcttggtcccgcggagaagcttaccatggagctcctaatcctcaaagccaacgcgatcactacaatcctcacagccgtcaccttctgcttcgcctccggccaaaacatcaccgaggagttctaccaatcaacctgctccgccgtatcaaaaggatacctaagcgccctacggaccggctggtacacatctgtcatcaccatcgaactatcaaacatcaaagaaaacaaatgcaacggaaccgacgcaaaagtcaaactgattaaacaagaactagacaaatacaaaaacgcagtcaccgaactgcaattactcatgcaaagcacaccggccaccggctcaggcagcgccatcgcctccggcgtcgccgtctgcaaagttctccacctcgagggcgaagtcaacaaaataaaatctgccctcctctccaccaacaaagccgtcgtctccctcagcggctgcggagtctccgtcctcaccttcaaagttctcgatctcaagaactatattgacaaacaacttctacccatactcaacaaacaaagctgcagcatatccaacatcgaaaccgtcatcgagttccaacaaaagaacaaccgcctcctcgaaataacccgcgagttcagcgttaacgccggagtcactacccctgtctccacctacatgctcaccaactccgaactcctatcactaatcaacgacatgcccataaccaacgaccagaagaaactcatgtccaacaacgtccaaattgtccgacaacaaagctactccataatgtgcataataaaagaggaagtcctcgcctacgtcgtacaactgcccctttatggcgtaatcgacacaccctgctggaaactccacacgtcacccctctgcaccaccaacacaaaagaaggctcgaacatctgcctaacacggactgaccgcggctggtactgcgacaacgccggctccgtcagcttcttcccacaagccgaaacctgcaaagtacaatccaaccgagtattctgcgacaccatgaactccagaaccctcccctcagaggtcaacctgtgcaacgtagacatcttcaaccccaaatacgactgcaaaataatgacctcaaaaacagacgtctcctcttccgtaatcaccagcctcggagccatcgtcagctgctacggcaaaaccaaatgcaccgcctcaaacaaatgccgcggcatcatcaaaacattctcaaacggctgcgactacgtctccaacaaaggcgtcgacacagtaagcgtaggcaacacactgtactacgtcaacaaacaagagggaaaatcactctacgtcaaaggagaacccataatcaacttctacgaccccctcgttttccccagcgacgagttcgacgccagcatatcccaagtcaacgagaaaattaaccaatccctagcattcatccgaaaatctgacgaactgctccacaacgtcaacgcgggaaaatcaacaaccaacataatgataaccacaatcataatagtcatcatcgtaatcctcctcagcctaatcgctgtcggcctcctcctctactgcaaagcccgttccaccccagtcacactttccaaggaccaactaagcggaataaacaacatcgcgttctcaaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5591 - RNA, 1970 nt, synthetic construct
  misc_feature 1..1970: note = mRNA product Design g-2 comprising derived and/or modified sequence from HRSV(A2)__F_DSCav1_mut5 (opt1)
  source 1..1970: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5592 - RNA, 1970 nt, synthetic construct
  misc_feature 1..1970: note = mRNA product Design g-2 comprising derived and/or modified sequence from HRSV(A2)__F_DSCav1_mut5 (opt1)
  source 1..1970: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcgggtgcggcgtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggggtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggcgtgatcgacacgccgtgctggaagctgcacaccagccccctctgcaccaccaacacgaaggaggggtccaacatctgcctgacccgcaccgaccggggctggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggggccatcgtgtcctgctacggcaagaccaagtgcaccgccagcaacaagtgccgggggatcatcaagaccttctccaacggctgcgactacgtgagcaacaagggcgtcgacacggtgagcgtggggaacaccctctactacgtcaacaagcaggagggcaagtccctgtacgtgaagggggagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccggcaagtccaccaccaacatcatgatcaccacgatcatcatcgtgatcatcgtcatcctcctgagcctgatcgccgtggggctcctgctgtactgcaaggcccggtccaccccggtgaccctgagcaaggaccagctctccggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5593 - RNA, 1970 nt, synthetic construct
  misc_feature 1..1970: note = mRNA product Design g-2 comprising derived and/or modified sequence from HRSV(A2)__F_DSCav1_mut5 (opt2)
  source 1..1970: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5594 - RNA, 1970 nt, synthetic construct
  misc_feature 1..1970: note = mRNA product Design g-2 comprising derived and/or modified sequence from HRSV(A2)__F_DSCav1_mut5 (opt3)
  source 1..1970: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcggttgcggggtgtccgtattaacttttaaggttctggaccttaagaactacattgataaacaattgctgcctatcctaaataagcagtcatgtagtattagcaacatcgagaccgtgatagagttccagcagaaaaataacaggctcctggaaattacacgggagttttctgtcaatgcgggagtgactaccccagtgtccacatatatgcttaccaactcagaactgttgagcctcatcaatgacatgccgattacgaacgatcaaaagaaactgatgagtaacaatgtccagatcgttcgccagcagtcttactccatcatgtgcattataaaggaggaagtgttagcatatgtagtgcaactgcccctctacggcgtcatcgacactccttgttggaaacttcatacaagcccactgtgcaccactaacacaaaggagggctcgaatatttgtttgacccgaacggatcgtgggtggtactgcgacaacgccggatctgtgtccttctttccccaggctgaaacctgtaaggttcagtcaaatagagtgttctgcgatacaatgaacagtagaactctgcctagcgaggtcaatctctgcaacgtggacatctttaatccaaaatatgattgtaagataatgacctccaaaacagacgtatctagctcagttattaccagtctgggtgccatcgtgtcctgctacggcaagactaaatgtacagcaagcaacaagtgcagggggatcattaagaccttctctaatggatgtgattatgtctcaaacaaaggcgtggacactgtcagtgtgggtaatacgctttactatgttaacaagcaagaggggaaaagcctgtacgtgaagggagaacccatcattaatttttatgaccctttggtattcccatccgatgagtttgacgcttctatatcgcaggtcaacgagaaaatcaaccagagcctcgccttcattcggaagtccgatgaactgttacacaatgtgaacgcgggcaagtcaacaaccaatatcatgatcactaccattataatcgttattatcgtgattctgctaagtctcatcgccgtcggcctgcttttgtactgcaaagcacgctctacaccggtgaccctgagcaaggaccagctctccgggataaacaatatcgctttctcaaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5595 - RNA, 1970 nt, synthetic construct
  misc_feature 1..1970: note = mRNA product Design g-2 comprising derived and/or modified sequence from HRSV(A2)__F_DSCav1_mut5 (opt4)
  source 1..1970: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5596 - RNA, 1970 nt, synthetic construct
  misc_feature 1..1970: note = mRNA product Design g-2 comprising derived and/or modified sequence from HRSV(A2)__F_DSCav1_mut5 (opt5)
  source 1..1970: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcggatgcggcgtttctgtgctgacatttaaggtccttgacctgaagaactacattgataaacaactcctgcctatcctgaataagcagtcctgtagcatttctaacatcgagaccgtgattgagttccagcagaaaaataaccggctcctggaaatcacgcgcgagttttccgtgaatgccggcgtcacaaccccggttagcacatatatgcttaccaactccgaactgctctctctgatcaatgacatgcccattaccaacgatcaaaagaaacttatgagcaacaatgtgcagatcgtgagacagcagtcctacagcattatgtgcatcattaaggaggaagtcctggcttatgtggttcaactccctctgtacggggtgatcgacacaccctgttggaaactgcatacgtctcctctctgcaccacaaacaccaaggagggatccaatatctgtctgacacggaccgatcgcggctggtactgcgacaacgccgggagcgtctctttctttccccaggcggaaacgtgtaaggtgcagagcaatagagttttctgcgatacaatgaactccagaaccctgccttctgaggtgaatctctgcaacgtcgacatttttaatccgaaatatgattgtaagatcatgaccagcaaaacagacgtgtccagctctgtcattacctccctgggagccatcgtgagctgctacggcaagacaaaatgtacggcttctaacaagtgccgggggattatcaagaccttctccaatggatgtgattatgttagcaacaaaggcgtggacacagtctccgtgggcaataccctttactatgttaacaagcaagaggggaaatctctgtacgtgaagggagaacccatcattaatttttatgaccctctcgtcttccccagcgatgagtttgacgcctccatctctcaggtgaacgagaaaattaaccagagcctggctttcatccgcaagtccgatgaactgctccacaatgtgaacgccggcaagagcacaaccaatattatgatcacgaccattatcatcgttattatcgtcattctgctttctctgatcgccgtggggctcctgctgtactgcaaagctagatccacacctgtgacccttagcaaggaccagctctctggaattaacaatatcgcgttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5597 - RNA, 1970 nt, synthetic construct
  misc_feature 1..1970: note = mRNA product Design g-2 comprising derived and/or modified sequence from HRSV(A2)__F_DSCav1_mut5 (opt6)
  source 1..1970: mol_type = other RNA
gggagagtccgctcagccaggttgcagaagcggcttagcgtgtgtcctaatcttctctctgcgtgtaggtaggcctgtgccgcaaacaagcttaccatggaactattaatacttaaagccaacgcaataacaacaattctcactgctgtcaccttctgcttcgcctcaggccaaaacataacggaagaattttaccaatcaacatgctctgcagtatccaaaggctacctatctgctctaagaacaggttggtatacatcagtaataaccatagaactatcaaacataaaagaaaataaatgcaacggaacagacgcaaaagttaaactcataaaacaagaactagacaaatataaaaacgcagttaccgaactacaactacttatgcaatccactcccgccactggatcaggatcagcaatagcatcaggagtcgcagtatgtaaagtcttacacctcgaaggcgaagtcaataaaatcaaatccgcattactatccacaaacaaagcagtcgtatccctaagcggatgcggagtatcagtactaacatttaaagtactagacctaaaaaattacatcgataaacaactattacctatattaaacaaacaatcctgctccatttcaaatatcgaaaccgtaatagaatttcaacaaaaaaacaacagattactagaaataacaagagaattttccgtaaatgctggcgtaacaacaccagtatccacatacatgctcacaaactccgaactactatcactaataaatgacatgcccataacaaacgatcaaaaaaaactaatgtcaaataatgtacaaatagtaagacaacaaagctactccatcatgtgtataataaaagaagaagtactagcatacgtagttcaactaccactttacggcgtaatcgacaccccttgctggaaactacacacctcccctctatgcaccacaaacacaaaagaaggttccaacatatgccttaccagaacagacagaggctggtattgcgacaacgcaggatcagtttcattttttccacaagctgaaacatgcaaagtacaatcaaacagagtcttctgcgacacaatgaactcaagaactctaccctcagaagtaaacctatgtaacgtagacattttcaaccccaaatacgactgcaaaattatgacatcaaaaacagacgtttcatcatcagttatcacctcattaggagcaatagtaagctgctacggaaaaacaaaatgcaccgcctcaaataaatgcagaggaataataaaaactttctccaacggatgcgactacgtttcaaacaaaggtgtagacactgtatcagtaggaaacacactatattacgtaaataaacaagaaggaaaatcactttatgtcaaaggagaaccaataatcaatttctacgacccattagtattcccatcagacgaatttgatgcttcaatatcacaagtaaacgaaaaaataaatcaatcactcgcatttatacgaaaatcagacgaactactacacaatgtaaacgcaggcaaatcaacaacaaacataatgataacaacaataatcattgtaataatagtaatacttctatctctaatagcagtaggattactcctctactgcaaagcaagatcaacccctgtaacactatcaaaagaccaactttcaggtataaataatatagctttttccaattaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5598 - RNA, 1970 nt, synthetic construct
  misc_feature 1..1970: note = mRNA product Design g-2 comprising derived and/or modified sequence from HRSV(A2)__F_DSCav1_mut5 (opt11)
  source 1..1970: mol_type = other RNA
gggagagtccgctcagccaggttgcagaagcggcttagcgtgtgtcctaatcttctctctgcgtgtaggtaggcctgtgccgcaaacaagcttaccatggagctcctaatcctcaaagccaacgcgatcactacaatcctcacagccgtcaccttctgcttcgcctccggccaaaacatcaccgaggagttctaccaatcaacctgctccgccgtatcaaaaggatacctaagcgccctacggaccggctggtacacatctgtcatcaccatcgaactatcaaacatcaaagaaaacaaatgcaacggaaccgacgcaaaagtcaaactgattaaacaagaactagacaaatacaaaaacgcagtcaccgaactgcaattactcatgcaaagcacaccggccaccggctcaggcagcgccatcgcctccggcgtcgccgtctgcaaagttctccacctcgagggcgaagtcaacaaaataaaatctgccctcctctccaccaacaaagccgtcgtctccctcagcggctgcggagtctccgtcctcaccttcaaagttctcgatctcaagaactatattgacaaacaacttctacccatactcaacaaacaaagctgcagcatatccaacatcgaaaccgtcatcgagttccaacaaaagaacaaccgcctcctcgaaataacccgcgagttcagcgttaacgccggagtcactacccctgtctccacctacatgctcaccaactccgaactcctatcactaatcaacgacatgcccataaccaacgaccagaagaaactcatgtccaacaacgtccaaattgtccgacaacaaagctactccataatgtgcataataaaagaggaagtcctcgcctacgtcgtacaactgcccctttatggcgtaatcgacacaccctgctggaaactccacacgtcacccctctgcaccaccaacacaaaagaaggctcgaacatctgcctaacacggactgaccgcggctggtactgcgacaacgccggctccgtcagcttcttcccacaagccgaaacctgcaaagtacaatccaaccgagtattctgcgacaccatgaactccagaaccctcccctcagaggtcaacctgtgcaacgtagacatcttcaaccccaaatacgactgcaaaataatgacctcaaaaacagacgtctcctcttccgtaatcaccagcctcggagccatcgtcagctgctacggcaaaaccaaatgcaccgcctcaaacaaatgccgcggcatcatcaaaacattctcaaacggctgcgactacgtctccaacaaaggcgtcgacacagtaagcgtaggcaacacactgtactacgtcaacaaacaagagggaaaatcactctacgtcaaaggagaacccataatcaacttctacgaccccctcgttttccccagcgacgagttcgacgccagcatatcccaagtcaacgagaaaattaaccaatccctagcattcatccgaaaatctgacgaactgctccacaacgtcaacgcgggaaaatcaacaaccaacataatgataaccacaatcataatagtcatcatcgtaatcctcctcagcctaatcgctgtcggcctcctcctctactgcaaagcccgttccaccccagtcacactttccaaggaccaactaagcggaataaacaacatcgcgttctcaaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5599 - RNA, 2202 nt, synthetic construct
  misc_feature 1..2202: note = mRNA product Design g-3 comprising derived and/or modified sequence from HRSV(A2)__F_DSCav1_mut5 (opt1)
  source 1..2202: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5600 - RNA, 2202 nt, synthetic construct
  misc_feature 1..2202: note = mRNA product Design g-3 comprising derived and/or modified sequence from HRSV(A2)__F_DSCav1_mut5 (opt1)
  source 1..2202: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcgggtgcggcgtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggggtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggcgtgatcgacacgccgtgctggaagctgcacaccagccccctctgcaccaccaacacgaaggaggggtccaacatctgcctgacccgcaccgaccggggctggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggggccatcgtgtcctgctacggcaagaccaagtgcaccgccagcaacaagtgccgggggatcatcaagaccttctccaacggctgcgactacgtgagcaacaagggcgtcgacacggtgagcgtggggaacaccctctactacgtcaacaagcaggagggcaagtccctgtacgtgaagggggagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccggcaagtccaccaccaacatcatgatcaccacgatcatcatcgtgatcatcgtcatcctcctgagcctgatcgccgtggggctcctgctgtactgcaaggcccggtccaccccggtgaccctgagcaaggaccagctctccggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5601 - RNA, 2202 nt, synthetic construct
  misc_feature 1..2202: note = mRNA product Design g-3 comprising derived and/or modified sequence from HRSV(A2)__F_DSCav1_mut5 (opt2)
  source 1..2202: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5602 - RNA, 2202 nt, synthetic construct
  misc_feature 1..2202: note = mRNA product Design g-3 comprising derived and/or modified sequence from HRSV(A2)__F_DSCav1_mut5 (opt3)
  source 1..2202: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcggttgcggggtgtccgtattaacttttaaggttctggaccttaagaactacattgataaacaattgctgcctatcctaaataagcagtcatgtagtattagcaacatcgagaccgtgatagagttccagcagaaaaataacaggctcctggaaattacacgggagttttctgtcaatgcgggagtgactaccccagtgtccacatatatgcttaccaactcagaactgttgagcctcatcaatgacatgccgattacgaacgatcaaaagaaactgatgagtaacaatgtccagatcgttcgccagcagtcttactccatcatgtgcattataaaggaggaagtgttagcatatgtagtgcaactgcccctctacggcgtcatcgacactccttgttggaaacttcatacaagcccactgtgcaccactaacacaaaggagggctcgaatatttgtttgacccgaacggatcgtgggtggtactgcgacaacgccggatctgtgtccttctttccccaggctgaaacctgtaaggttcagtcaaatagagtgttctgcgatacaatgaacagtagaactctgcctagcgaggtcaatctctgcaacgtggacatctttaatccaaaatatgattgtaagataatgacctccaaaacagacgtatctagctcagttattaccagtctgggtgccatcgtgtcctgctacggcaagactaaatgtacagcaagcaacaagtgcagggggatcattaagaccttctctaatggatgtgattatgtctcaaacaaaggcgtggacactgtcagtgtgggtaatacgctttactatgttaacaagcaagaggggaaaagcctgtacgtgaagggagaacccatcattaatttttatgaccctttggtattcccatccgatgagtttgacgcttctatatcgcaggtcaacgagaaaatcaaccagagcctcgccttcattcggaagtccgatgaactgttacacaatgtgaacgcgggcaagtcaacaaccaatatcatgatcactaccattataatcgttattatcgtgattctgctaagtctcatcgccgtcggcctgcttttgtactgcaaagcacgctctacaccggtgaccctgagcaaggaccagctctccgggataaacaatatcgctttctcaaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5603 - RNA, 2202 nt, synthetic construct
  misc_feature 1..2202: note = mRNA product Design g-3 comprising derived and/or modified sequence from HRSV(A2)__F_DSCav1_mut5 (opt4)
  source 1..2202: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5604 - RNA, 2202 nt, synthetic construct
  misc_feature 1..2202: note = mRNA product Design g-3 comprising derived and/or modified sequence from HRSV(A2)__F_DSCav1_mut5 (opt5)
  source 1..2202: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcggatgcggcgtttctgtgctgacatttaaggtccttgacctgaagaactacattgataaacaactcctgcctatcctgaataagcagtcctgtagcatttctaacatcgagaccgtgattgagttccagcagaaaaataaccggctcctggaaatcacgcgcgagttttccgtgaatgccggcgtcacaaccccggttagcacatatatgcttaccaactccgaactgctctctctgatcaatgacatgcccattaccaacgatcaaaagaaacttatgagcaacaatgtgcagatcgtgagacagcagtcctacagcattatgtgcatcattaaggaggaagtcctggcttatgtggttcaactccctctgtacggggtgatcgacacaccctgttggaaactgcatacgtctcctctctgcaccacaaacaccaaggagggatccaatatctgtctgacacggaccgatcgcggctggtactgcgacaacgccgggagcgtctctttctttccccaggcggaaacgtgtaaggtgcagagcaatagagttttctgcgatacaatgaactccagaaccctgccttctgaggtgaatctctgcaacgtcgacatttttaatccgaaatatgattgtaagatcatgaccagcaaaacagacgtgtccagctctgtcattacctccctgggagccatcgtgagctgctacggcaagacaaaatgtacggcttctaacaagtgccgggggattatcaagaccttctccaatggatgtgattatgttagcaacaaaggcgtggacacagtctccgtgggcaataccctttactatgttaacaagcaagaggggaaatctctgtacgtgaagggagaacccatcattaatttttatgaccctctcgtcttccccagcgatgagtttgacgcctccatctctcaggtgaacgagaaaattaaccagagcctggctttcatccgcaagtccgatgaactgctccacaatgtgaacgccggcaagagcacaaccaatattatgatcacgaccattatcatcgttattatcgtcattctgctttctctgatcgccgtggggctcctgctgtactgcaaagctagatccacacctgtgacccttagcaaggaccagctctctggaattaacaatatcgcgttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5605 - RNA, 2202 nt, synthetic construct
  misc_feature 1..2202: note = mRNA product Design g-3 comprising derived and/or modified sequence from HRSV(A2)__F_DSCav1_mut5 (opt6)
  source 1..2202: mol_type = other RNA
gggagagtccgctcagccaggttgcagaagcggcttagcgtgtgtcctaatcttctctctgcgtgtaggtaggcctgtgccgcaaacaagcttaccatggaactattaatacttaaagccaacgcaataacaacaattctcactgctgtcaccttctgcttcgcctcaggccaaaacataacggaagaattttaccaatcaacatgctctgcagtatccaaaggctacctatctgctctaagaacaggttggtatacatcagtaataaccatagaactatcaaacataaaagaaaataaatgcaacggaacagacgcaaaagttaaactcataaaacaagaactagacaaatataaaaacgcagttaccgaactacaactacttatgcaatccactcccgccactggatcaggatcagcaatagcatcaggagtcgcagtatgtaaagtcttacacctcgaaggcgaagtcaataaaatcaaatccgcattactatccacaaacaaagcagtcgtatccctaagcggatgcggagtatcagtactaacatttaaagtactagacctaaaaaattacatcgataaacaactattacctatattaaacaaacaatcctgctccatttcaaatatcgaaaccgtaatagaatttcaacaaaaaaacaacagattactagaaataacaagagaattttccgtaaatgctggcgtaacaacaccagtatccacatacatgctcacaaactccgaactactatcactaataaatgacatgcccataacaaacgatcaaaaaaaactaatgtcaaataatgtacaaatagtaagacaacaaagctactccatcatgtgtataataaaagaagaagtactagcatacgtagttcaactaccactttacggcgtaatcgacaccccttgctggaaactacacacctcccctctatgcaccacaaacacaaaagaaggttccaacatatgccttaccagaacagacagaggctggtattgcgacaacgcaggatcagtttcattttttccacaagctgaaacatgcaaagtacaatcaaacagagtcttctgcgacacaatgaactcaagaactctaccctcagaagtaaacctatgtaacgtagacattttcaaccccaaatacgactgcaaaattatgacatcaaaaacagacgtttcatcatcagttatcacctcattaggagcaatagtaagctgctacggaaaaacaaaatgcaccgcctcaaataaatgcagaggaataataaaaactttctccaacggatgcgactacgtttcaaacaaaggtgtagacactgtatcagtaggaaacacactatattacgtaaataaacaagaaggaaaatcactttatgtcaaaggagaaccaataatcaatttctacgacccattagtattcccatcagacgaatttgatgcttcaatatcacaagtaaacgaaaaaataaatcaatcactcgcatttatacgaaaatcagacgaactactacacaatgtaaacgcaggcaaatcaacaacaaacataatgataacaacaataatcattgtaataatagtaatacttctatctctaatagcagtaggattactcctctactgcaaagcaagatcaacccctgtaacactatcaaaagaccaactttcaggtataaataatatagctttttccaattaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5606 - RNA, 2202 nt, synthetic construct
  misc_feature 1..2202: note = mRNA product Design g-3 comprising derived and/or modified sequence from HRSV(A2)__F_DSCav1_mut5 (opt11)
  source 1..2202: mol_type = other RNA
gggagagtccgctcagccaggttgcagaagcggcttagcgtgtgtcctaatcttctctctgcgtgtaggtaggcctgtgccgcaaacaagcttaccatggagctcctaatcctcaaagccaacgcgatcactacaatcctcacagccgtcaccttctgcttcgcctccggccaaaacatcaccgaggagttctaccaatcaacctgctccgccgtatcaaaaggatacctaagcgccctacggaccggctggtacacatctgtcatcaccatcgaactatcaaacatcaaagaaaacaaatgcaacggaaccgacgcaaaagtcaaactgattaaacaagaactagacaaatacaaaaacgcagtcaccgaactgcaattactcatgcaaagcacaccggccaccggctcaggcagcgccatcgcctccggcgtcgccgtctgcaaagttctccacctcgagggcgaagtcaacaaaataaaatctgccctcctctccaccaacaaagccgtcgtctccctcagcggctgcggagtctccgtcctcaccttcaaagttctcgatctcaagaactatattgacaaacaacttctacccatactcaacaaacaaagctgcagcatatccaacatcgaaaccgtcatcgagttccaacaaaagaacaaccgcctcctcgaaataacccgcgagttcagcgttaacgccggagtcactacccctgtctccacctacatgctcaccaactccgaactcctatcactaatcaacgacatgcccataaccaacgaccagaagaaactcatgtccaacaacgtccaaattgtccgacaacaaagctactccataatgtgcataataaaagaggaagtcctcgcctacgtcgtacaactgcccctttatggcgtaatcgacacaccctgctggaaactccacacgtcacccctctgcaccaccaacacaaaagaaggctcgaacatctgcctaacacggactgaccgcggctggtactgcgacaacgccggctccgtcagcttcttcccacaagccgaaacctgcaaagtacaatccaaccgagtattctgcgacaccatgaactccagaaccctcccctcagaggtcaacctgtgcaacgtagacatcttcaaccccaaatacgactgcaaaataatgacctcaaaaacagacgtctcctcttccgtaatcaccagcctcggagccatcgtcagctgctacggcaaaaccaaatgcaccgcctcaaacaaatgccgcggcatcatcaaaacattctcaaacggctgcgactacgtctccaacaaaggcgtcgacacagtaagcgtaggcaacacactgtactacgtcaacaaacaagagggaaaatcactctacgtcaaaggagaacccataatcaacttctacgaccccctcgttttccccagcgacgagttcgacgccagcatatcccaagtcaacgagaaaattaaccaatccctagcattcatccgaaaatctgacgaactgctccacaacgtcaacgcgggaaaatcaacaaccaacataatgataaccacaatcataatagtcatcatcgtaatcctcctcagcctaatcgctgtcggcctcctcctctactgcaaagcccgttccaccccagtcacactttccaaggaccaactaagcggaataaacaacatcgcgttctcaaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5607 - RNA, 1997 nt, synthetic construct
  misc_feature 1..1997: note = mRNA product Design g-4 comprising derived and/or modified sequence from HRSV(A2)__F_DSCav1_mut5 (opt1)
  source 1..1997: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5608 - RNA, 1997 nt, synthetic construct
  misc_feature 1..1997: note = mRNA product Design g-4 comprising derived and/or modified sequence from HRSV(A2)__F_DSCav1_mut5 (opt1)
  source 1..1997: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcgggtgcggcgtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggggtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggcgtgatcgacacgccgtgctggaagctgcacaccagccccctctgcaccaccaacacgaaggaggggtccaacatctgcctgacccgcaccgaccggggctggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggggccatcgtgtcctgctacggcaagaccaagtgcaccgccagcaacaagtgccgggggatcatcaagaccttctccaacggctgcgactacgtgagcaacaagggcgtcgacacggtgagcgtggggaacaccctctactacgtcaacaagcaggagggcaagtccctgtacgtgaagggggagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccggcaagtccaccaccaacatcatgatcaccacgatcatcatcgtgatcatcgtcatcctcctgagcctgatcgccgtggggctcctgctgtactgcaaggcccggtccaccccggtgaccctgagcaaggaccagctctccggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5609 - RNA, 1997 nt, synthetic construct
  misc_feature 1..1997: note = mRNA product Design g-4 comprising derived and/or modified sequence from HRSV(A2)__F_DSCav1_mut5 (opt2)
  source 1..1997: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5610 - RNA, 1997 nt, synthetic construct
  misc_feature 1..1997: note = mRNA product Design g-4 comprising derived and/or modified sequence from HRSV(A2)__F_DSCav1_mut5 (opt3)
  source 1..1997: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcggttgcggggtgtccgtattaacttttaaggttctggaccttaagaactacattgataaacaattgctgcctatcctaaataagcagtcatgtagtattagcaacatcgagaccgtgatagagttccagcagaaaaataacaggctcctggaaattacacgggagttttctgtcaatgcgggagtgactaccccagtgtccacatatatgcttaccaactcagaactgttgagcctcatcaatgacatgccgattacgaacgatcaaaagaaactgatgagtaacaatgtccagatcgttcgccagcagtcttactccatcatgtgcattataaaggaggaagtgttagcatatgtagtgcaactgcccctctacggcgtcatcgacactccttgttggaaacttcatacaagcccactgtgcaccactaacacaaaggagggctcgaatatttgtttgacccgaacggatcgtgggtggtactgcgacaacgccggatctgtgtccttctttccccaggctgaaacctgtaaggttcagtcaaatagagtgttctgcgatacaatgaacagtagaactctgcctagcgaggtcaatctctgcaacgtggacatctttaatccaaaatatgattgtaagataatgacctccaaaacagacgtatctagctcagttattaccagtctgggtgccatcgtgtcctgctacggcaagactaaatgtacagcaagcaacaagtgcagggggatcattaagaccttctctaatggatgtgattatgtctcaaacaaaggcgtggacactgtcagtgtgggtaatacgctttactatgttaacaagcaagaggggaaaagcctgtacgtgaagggagaacccatcattaatttttatgaccctttggtattcccatccgatgagtttgacgcttctatatcgcaggtcaacgagaaaatcaaccagagcctcgccttcattcggaagtccgatgaactgttacacaatgtgaacgcgggcaagtcaacaaccaatatcatgatcactaccattataatcgttattatcgtgattctgctaagtctcatcgccgtcggcctgcttttgtactgcaaagcacgctctacaccggtgaccctgagcaaggaccagctctccgggataaacaatatcgctttctcaaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5611 - RNA, 1997 nt, synthetic construct
  misc_feature 1..1997: note = mRNA product Design g-4 comprising derived and/or modified sequence from HRSV(A2)__F_DSCav1_mut5 (opt4)
  source 1..1997: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5612 - RNA, 1997 nt, synthetic construct
  misc_feature 1..1997: note = mRNA product Design g-4 comprising derived and/or modified sequence from HRSV(A2)__F_DSCav1_mut5 (opt5)
  source 1..1997: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcggatgcggcgtttctgtgctgacatttaaggtccttgacctgaagaactacattgataaacaactcctgcctatcctgaataagcagtcctgtagcatttctaacatcgagaccgtgattgagttccagcagaaaaataaccggctcctggaaatcacgcgcgagttttccgtgaatgccggcgtcacaaccccggttagcacatatatgcttaccaactccgaactgctctctctgatcaatgacatgcccattaccaacgatcaaaagaaacttatgagcaacaatgtgcagatcgtgagacagcagtcctacagcattatgtgcatcattaaggaggaagtcctggcttatgtggttcaactccctctgtacggggtgatcgacacaccctgttggaaactgcatacgtctcctctctgcaccacaaacaccaaggagggatccaatatctgtctgacacggaccgatcgcggctggtactgcgacaacgccgggagcgtctctttctttccccaggcggaaacgtgtaaggtgcagagcaatagagttttctgcgatacaatgaactccagaaccctgccttctgaggtgaatctctgcaacgtcgacatttttaatccgaaatatgattgtaagatcatgaccagcaaaacagacgtgtccagctctgtcattacctccctgggagccatcgtgagctgctacggcaagacaaaatgtacggcttctaacaagtgccgggggattatcaagaccttctccaatggatgtgattatgttagcaacaaaggcgtggacacagtctccgtgggcaataccctttactatgttaacaagcaagaggggaaatctctgtacgtgaagggagaacccatcattaatttttatgaccctctcgtcttccccagcgatgagtttgacgcctccatctctcaggtgaacgagaaaattaaccagagcctggctttcatccgcaagtccgatgaactgctccacaatgtgaacgccggcaagagcacaaccaatattatgatcacgaccattatcatcgttattatcgtcattctgctttctctgatcgccgtggggctcctgctgtactgcaaagctagatccacacctgtgacccttagcaaggaccagctctctggaattaacaatatcgcgttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5613 - RNA, 1997 nt, synthetic construct
  misc_feature 1..1997: note = mRNA product Design g-4 comprising derived and/or modified sequence from HRSV(A2)__F_DSCav1_mut5 (opt6)
  source 1..1997: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactattaatacttaaagccaacgcaataacaacaattctcactgctgtcaccttctgcttcgcctcaggccaaaacataacggaagaattttaccaatcaacatgctctgcagtatccaaaggctacctatctgctctaagaacaggttggtatacatcagtaataaccatagaactatcaaacataaaagaaaataaatgcaacggaacagacgcaaaagttaaactcataaaacaagaactagacaaatataaaaacgcagttaccgaactacaactacttatgcaatccactcccgccactggatcaggatcagcaatagcatcaggagtcgcagtatgtaaagtcttacacctcgaaggcgaagtcaataaaatcaaatccgcattactatccacaaacaaagcagtcgtatccctaagcggatgcggagtatcagtactaacatttaaagtactagacctaaaaaattacatcgataaacaactattacctatattaaacaaacaatcctgctccatttcaaatatcgaaaccgtaatagaatttcaacaaaaaaacaacagattactagaaataacaagagaattttccgtaaatgctggcgtaacaacaccagtatccacatacatgctcacaaactccgaactactatcactaataaatgacatgcccataacaaacgatcaaaaaaaactaatgtcaaataatgtacaaatagtaagacaacaaagctactccatcatgtgtataataaaagaagaagtactagcatacgtagttcaactaccactttacggcgtaatcgacaccccttgctggaaactacacacctcccctctatgcaccacaaacacaaaagaaggttccaacatatgccttaccagaacagacagaggctggtattgcgacaacgcaggatcagtttcattttttccacaagctgaaacatgcaaagtacaatcaaacagagtcttctgcgacacaatgaactcaagaactctaccctcagaagtaaacctatgtaacgtagacattttcaaccccaaatacgactgcaaaattatgacatcaaaaacagacgtttcatcatcagttatcacctcattaggagcaatagtaagctgctacggaaaaacaaaatgcaccgcctcaaataaatgcagaggaataataaaaactttctccaacggatgcgactacgtttcaaacaaaggtgtagacactgtatcagtaggaaacacactatattacgtaaataaacaagaaggaaaatcactttatgtcaaaggagaaccaataatcaatttctacgacccattagtattcccatcagacgaatttgatgcttcaatatcacaagtaaacgaaaaaataaatcaatcactcgcatttatacgaaaatcagacgaactactacacaatgtaaacgcaggcaaatcaacaacaaacataatgataacaacaataatcattgtaataatagtaatacttctatctctaatagcagtaggattactcctctactgcaaagcaagatcaacccctgtaacactatcaaaagaccaactttcaggtataaataatatagctttttccaattaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5614 - RNA, 1997 nt, synthetic construct
  misc_feature 1..1997: note = mRNA product Design g-4 comprising derived and/or modified sequence from HRSV(A2)__F_DSCav1_mut5 (opt11)
  source 1..1997: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctaatcctcaaagccaacgcgatcactacaatcctcacagccgtcaccttctgcttcgcctccggccaaaacatcaccgaggagttctaccaatcaacctgctccgccgtatcaaaaggatacctaagcgccctacggaccggctggtacacatctgtcatcaccatcgaactatcaaacatcaaagaaaacaaatgcaacggaaccgacgcaaaagtcaaactgattaaacaagaactagacaaatacaaaaacgcagtcaccgaactgcaattactcatgcaaagcacaccggccaccggctcaggcagcgccatcgcctccggcgtcgccgtctgcaaagttctccacctcgagggcgaagtcaacaaaataaaatctgccctcctctccaccaacaaagccgtcgtctccctcagcggctgcggagtctccgtcctcaccttcaaagttctcgatctcaagaactatattgacaaacaacttctacccatactcaacaaacaaagctgcagcatatccaacatcgaaaccgtcatcgagttccaacaaaagaacaaccgcctcctcgaaataacccgcgagttcagcgttaacgccggagtcactacccctgtctccacctacatgctcaccaactccgaactcctatcactaatcaacgacatgcccataaccaacgaccagaagaaactcatgtccaacaacgtccaaattgtccgacaacaaagctactccataatgtgcataataaaagaggaagtcctcgcctacgtcgtacaactgcccctttatggcgtaatcgacacaccctgctggaaactccacacgtcacccctctgcaccaccaacacaaaagaaggctcgaacatctgcctaacacggactgaccgcggctggtactgcgacaacgccggctccgtcagcttcttcccacaagccgaaacctgcaaagtacaatccaaccgagtattctgcgacaccatgaactccagaaccctcccctcagaggtcaacctgtgcaacgtagacatcttcaaccccaaatacgactgcaaaataatgacctcaaaaacagacgtctcctcttccgtaatcaccagcctcggagccatcgtcagctgctacggcaaaaccaaatgcaccgcctcaaacaaatgccgcggcatcatcaaaacattctcaaacggctgcgactacgtctccaacaaaggcgtcgacacagtaagcgtaggcaacacactgtactacgtcaacaaacaagagggaaaatcactctacgtcaaaggagaacccataatcaacttctacgaccccctcgttttccccagcgacgagttcgacgccagcatatcccaagtcaacgagaaaattaaccaatccctagcattcatccgaaaatctgacgaactgctccacaacgtcaacgcgggaaaatcaacaaccaacataatgataaccacaatcataatagtcatcatcgtaatcctcctcagcctaatcgctgtcggcctcctcctctactgcaaagcccgttccaccccagtcacactttccaaggaccaactaagcggaataaacaacatcgcgttctcaaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5615 - RNA, 1973 nt, synthetic construct
  misc_feature 1..1973: note = mRNA product Design g-5 comprising derived and/or modified sequence from HRSV(A2)__F_DSCav1_mut5 (opt1)
  source 1..1973: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5616 - RNA, 1973 nt, synthetic construct
  misc_feature 1..1973: note = mRNA product Design g-5 comprising derived and/or modified sequence from HRSV(A2)__F_DSCav1_mut5 (opt1)
  source 1..1973: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcgggtgcggcgtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggggtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggcgtgatcgacacgccgtgctggaagctgcacaccagccccctctgcaccaccaacacgaaggaggggtccaacatctgcctgacccgcaccgaccggggctggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggggccatcgtgtcctgctacggcaagaccaagtgcaccgccagcaacaagtgccgggggatcatcaagaccttctccaacggctgcgactacgtgagcaacaagggcgtcgacacggtgagcgtggggaacaccctctactacgtcaacaagcaggagggcaagtccctgtacgtgaagggggagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccggcaagtccaccaccaacatcatgatcaccacgatcatcatcgtgatcatcgtcatcctcctgagcctgatcgccgtggggctcctgctgtactgcaaggcccggtccaccccggtgaccctgagcaaggaccagctctccggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5617 - RNA, 1973 nt, synthetic construct
  misc_feature 1..1973: note = mRNA product Design g-5 comprising derived and/or modified sequence from HRSV(A2)__F_DSCav1_mut5 (opt2)
  source 1..1973: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5618 - RNA, 1973 nt, synthetic construct
  misc_feature 1..1973: note = mRNA product Design g-5 comprising derived and/or modified sequence from HRSV(A2)__F_DSCav1_mut5 (opt3)
  source 1..1973: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcggttgcggggtgtccgtattaacttttaaggttctggaccttaagaactacattgataaacaattgctgcctatcctaaataagcagtcatgtagtattagcaacatcgagaccgtgatagagttccagcagaaaaataacaggctcctggaaattacacgggagttttctgtcaatgcgggagtgactaccccagtgtccacatatatgcttaccaactcagaactgttgagcctcatcaatgacatgccgattacgaacgatcaaaagaaactgatgagtaacaatgtccagatcgttcgccagcagtcttactccatcatgtgcattataaaggaggaagtgttagcatatgtagtgcaactgcccctctacggcgtcatcgacactccttgttggaaacttcatacaagcccactgtgcaccactaacacaaaggagggctcgaatatttgtttgacccgaacggatcgtgggtggtactgcgacaacgccggatctgtgtccttctttccccaggctgaaacctgtaaggttcagtcaaatagagtgttctgcgatacaatgaacagtagaactctgcctagcgaggtcaatctctgcaacgtggacatctttaatccaaaatatgattgtaagataatgacctccaaaacagacgtatctagctcagttattaccagtctgggtgccatcgtgtcctgctacggcaagactaaatgtacagcaagcaacaagtgcagggggatcattaagaccttctctaatggatgtgattatgtctcaaacaaaggcgtggacactgtcagtgtgggtaatacgctttactatgttaacaagcaagaggggaaaagcctgtacgtgaagggagaacccatcattaatttttatgaccctttggtattcccatccgatgagtttgacgcttctatatcgcaggtcaacgagaaaatcaaccagagcctcgccttcattcggaagtccgatgaactgttacacaatgtgaacgcgggcaagtcaacaaccaatatcatgatcactaccattataatcgttattatcgtgattctgctaagtctcatcgccgtcggcctgcttttgtactgcaaagcacgctctacaccggtgaccctgagcaaggaccagctctccgggataaacaatatcgctttctcaaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5619 - RNA, 1973 nt, synthetic construct
  misc_feature 1..1973: note = mRNA product Design g-5 comprising derived and/or modified sequence from HRSV(A2)__F_DSCav1_mut5 (opt4)
  source 1..1973: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5620 - RNA, 1973 nt, synthetic construct
  misc_feature 1..1973: note = mRNA product Design g-5 comprising derived and/or modified sequence from HRSV(A2)__F_DSCav1_mut5 (opt5)
  source 1..1973: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcggatgcggcgtttctgtgctgacatttaaggtccttgacctgaagaactacattgataaacaactcctgcctatcctgaataagcagtcctgtagcatttctaacatcgagaccgtgattgagttccagcagaaaaataaccggctcctggaaatcacgcgcgagttttccgtgaatgccggcgtcacaaccccggttagcacatatatgcttaccaactccgaactgctctctctgatcaatgacatgcccattaccaacgatcaaaagaaacttatgagcaacaatgtgcagatcgtgagacagcagtcctacagcattatgtgcatcattaaggaggaagtcctggcttatgtggttcaactccctctgtacggggtgatcgacacaccctgttggaaactgcatacgtctcctctctgcaccacaaacaccaaggagggatccaatatctgtctgacacggaccgatcgcggctggtactgcgacaacgccgggagcgtctctttctttccccaggcggaaacgtgtaaggtgcagagcaatagagttttctgcgatacaatgaactccagaaccctgccttctgaggtgaatctctgcaacgtcgacatttttaatccgaaatatgattgtaagatcatgaccagcaaaacagacgtgtccagctctgtcattacctccctgggagccatcgtgagctgctacggcaagacaaaatgtacggcttctaacaagtgccgggggattatcaagaccttctccaatggatgtgattatgttagcaacaaaggcgtggacacagtctccgtgggcaataccctttactatgttaacaagcaagaggggaaatctctgtacgtgaagggagaacccatcattaatttttatgaccctctcgtcttccccagcgatgagtttgacgcctccatctctcaggtgaacgagaaaattaaccagagcctggctttcatccgcaagtccgatgaactgctccacaatgtgaacgccggcaagagcacaaccaatattatgatcacgaccattatcatcgttattatcgtcattctgctttctctgatcgccgtggggctcctgctgtactgcaaagctagatccacacctgtgacccttagcaaggaccagctctctggaattaacaatatcgcgttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5621 - RNA, 1973 nt, synthetic construct
  misc_feature 1..1973: note = mRNA product Design g-5 comprising derived and/or modified sequence from HRSV(A2)__F_DSCav1_mut5 (opt6)
  source 1..1973: mol_type = other RNA
gggagacccgtgacccggaagttgtacggctacgcgactttccctcccacaaaccctcgcgcccttcctttcctacttgggcccggcagaaagcttaccatggaactattaatacttaaagccaacgcaataacaacaattctcactgctgtcaccttctgcttcgcctcaggccaaaacataacggaagaattttaccaatcaacatgctctgcagtatccaaaggctacctatctgctctaagaacaggttggtatacatcagtaataaccatagaactatcaaacataaaagaaaataaatgcaacggaacagacgcaaaagttaaactcataaaacaagaactagacaaatataaaaacgcagttaccgaactacaactacttatgcaatccactcccgccactggatcaggatcagcaatagcatcaggagtcgcagtatgtaaagtcttacacctcgaaggcgaagtcaataaaatcaaatccgcattactatccacaaacaaagcagtcgtatccctaagcggatgcggagtatcagtactaacatttaaagtactagacctaaaaaattacatcgataaacaactattacctatattaaacaaacaatcctgctccatttcaaatatcgaaaccgtaatagaatttcaacaaaaaaacaacagattactagaaataacaagagaattttccgtaaatgctggcgtaacaacaccagtatccacatacatgctcacaaactccgaactactatcactaataaatgacatgcccataacaaacgatcaaaaaaaactaatgtcaaataatgtacaaatagtaagacaacaaagctactccatcatgtgtataataaaagaagaagtactagcatacgtagttcaactaccactttacggcgtaatcgacaccccttgctggaaactacacacctcccctctatgcaccacaaacacaaaagaaggttccaacatatgccttaccagaacagacagaggctggtattgcgacaacgcaggatcagtttcattttttccacaagctgaaacatgcaaagtacaatcaaacagagtcttctgcgacacaatgaactcaagaactctaccctcagaagtaaacctatgtaacgtagacattttcaaccccaaatacgactgcaaaattatgacatcaaaaacagacgtttcatcatcagttatcacctcattaggagcaatagtaagctgctacggaaaaacaaaatgcaccgcctcaaataaatgcagaggaataataaaaactttctccaacggatgcgactacgtttcaaacaaaggtgtagacactgtatcagtaggaaacacactatattacgtaaataaacaagaaggaaaatcactttatgtcaaaggagaaccaataatcaatttctacgacccattagtattcccatcagacgaatttgatgcttcaatatcacaagtaaacgaaaaaataaatcaatcactcgcatttatacgaaaatcagacgaactactacacaatgtaaacgcaggcaaatcaacaacaaacataatgataacaacaataatcattgtaataatagtaatacttctatctctaatagcagtaggattactcctctactgcaaagcaagatcaacccctgtaacactatcaaaagaccaactttcaggtataaataatatagctttttccaattaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5622 - RNA, 1973 nt, synthetic construct
  misc_feature 1..1973: note = mRNA product Design g-5 comprising derived and/or modified sequence from HRSV(A2)__F_DSCav1_mut5 (opt11)
  source 1..1973: mol_type = other RNA
gggagacccgtgacccggaagttgtacggctacgcgactttccctcccacaaaccctcgcgcccttcctttcctacttgggcccggcagaaagcttaccatggagctcctaatcctcaaagccaacgcgatcactacaatcctcacagccgtcaccttctgcttcgcctccggccaaaacatcaccgaggagttctaccaatcaacctgctccgccgtatcaaaaggatacctaagcgccctacggaccggctggtacacatctgtcatcaccatcgaactatcaaacatcaaagaaaacaaatgcaacggaaccgacgcaaaagtcaaactgattaaacaagaactagacaaatacaaaaacgcagtcaccgaactgcaattactcatgcaaagcacaccggccaccggctcaggcagcgccatcgcctccggcgtcgccgtctgcaaagttctccacctcgagggcgaagtcaacaaaataaaatctgccctcctctccaccaacaaagccgtcgtctccctcagcggctgcggagtctccgtcctcaccttcaaagttctcgatctcaagaactatattgacaaacaacttctacccatactcaacaaacaaagctgcagcatatccaacatcgaaaccgtcatcgagttccaacaaaagaacaaccgcctcctcgaaataacccgcgagttcagcgttaacgccggagtcactacccctgtctccacctacatgctcaccaactccgaactcctatcactaatcaacgacatgcccataaccaacgaccagaagaaactcatgtccaacaacgtccaaattgtccgacaacaaagctactccataatgtgcataataaaagaggaagtcctcgcctacgtcgtacaactgcccctttatggcgtaatcgacacaccctgctggaaactccacacgtcacccctctgcaccaccaacacaaaagaaggctcgaacatctgcctaacacggactgaccgcggctggtactgcgacaacgccggctccgtcagcttcttcccacaagccgaaacctgcaaagtacaatccaaccgagtattctgcgacaccatgaactccagaaccctcccctcagaggtcaacctgtgcaacgtagacatcttcaaccccaaatacgactgcaaaataatgacctcaaaaacagacgtctcctcttccgtaatcaccagcctcggagccatcgtcagctgctacggcaaaaccaaatgcaccgcctcaaacaaatgccgcggcatcatcaaaacattctcaaacggctgcgactacgtctccaacaaaggcgtcgacacagtaagcgtaggcaacacactgtactacgtcaacaaacaagagggaaaatcactctacgtcaaaggagaacccataatcaacttctacgaccccctcgttttccccagcgacgagttcgacgccagcatatcccaagtcaacgagaaaattaaccaatccctagcattcatccgaaaatctgacgaactgctccacaacgtcaacgcgggaaaatcaacaaccaacataatgataaccacaatcataatagtcatcatcgtaatcctcctcagcctaatcgctgtcggcctcctcctctactgcaaagcccgttccaccccagtcacactttccaaggaccaactaagcggaataaacaacatcgcgttctcaaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5623 - RNA, 1989 nt, synthetic construct
  misc_feature 1..1989: note = mRNA product Design h-1 comprising derived and/or modified sequence from HRSV(A2)__F_DSCav1_mut5 (opt1)
  source 1..1989: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5624 - RNA, 1989 nt, synthetic construct
  misc_feature 1..1989: note = mRNA product Design h-1 comprising derived and/or modified sequence from HRSV(A2)__F_DSCav1_mut5 (opt1)
  source 1..1989: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcgggtgcggcgtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggggtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggcgtgatcgacacgccgtgctggaagctgcacaccagccccctctgcaccaccaacacgaaggaggggtccaacatctgcctgacccgcaccgaccggggctggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggggccatcgtgtcctgctacggcaagaccaagtgcaccgccagcaacaagtgccgggggatcatcaagaccttctccaacggctgcgactacgtgagcaacaagggcgtcgacacggtgagcgtggggaacaccctctactacgtcaacaagcaggagggcaagtccctgtacgtgaagggggagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccggcaagtccaccaccaacatcatgatcaccacgatcatcatcgtgatcatcgtcatcctcctgagcctgatcgccgtggggctcctgctgtactgcaaggcccggtccaccccggtgaccctgagcaaggaccagctctccggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5625 - RNA, 1989 nt, synthetic construct
  misc_feature 1..1989: note = mRNA product Design h-1 comprising derived and/or modified sequence from HRSV(A2)__F_DSCav1_mut5 (opt2)
  source 1..1989: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5626 - RNA, 1989 nt, synthetic construct
  misc_feature 1..1989: note = mRNA product Design h-1 comprising derived and/or modified sequence from HRSV(A2)__F_DSCav1_mut5 (opt3)
  source 1..1989: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcggttgcggggtgtccgtattaacttttaaggttctggaccttaagaactacattgataaacaattgctgcctatcctaaataagcagtcatgtagtattagcaacatcgagaccgtgatagagttccagcagaaaaataacaggctcctggaaattacacgggagttttctgtcaatgcgggagtgactaccccagtgtccacatatatgcttaccaactcagaactgttgagcctcatcaatgacatgccgattacgaacgatcaaaagaaactgatgagtaacaatgtccagatcgttcgccagcagtcttactccatcatgtgcattataaaggaggaagtgttagcatatgtagtgcaactgcccctctacggcgtcatcgacactccttgttggaaacttcatacaagcccactgtgcaccactaacacaaaggagggctcgaatatttgtttgacccgaacggatcgtgggtggtactgcgacaacgccggatctgtgtccttctttccccaggctgaaacctgtaaggttcagtcaaatagagtgttctgcgatacaatgaacagtagaactctgcctagcgaggtcaatctctgcaacgtggacatctttaatccaaaatatgattgtaagataatgacctccaaaacagacgtatctagctcagttattaccagtctgggtgccatcgtgtcctgctacggcaagactaaatgtacagcaagcaacaagtgcagggggatcattaagaccttctctaatggatgtgattatgtctcaaacaaaggcgtggacactgtcagtgtgggtaatacgctttactatgttaacaagcaagaggggaaaagcctgtacgtgaagggagaacccatcattaatttttatgaccctttggtattcccatccgatgagtttgacgcttctatatcgcaggtcaacgagaaaatcaaccagagcctcgccttcattcggaagtccgatgaactgttacacaatgtgaacgcgggcaagtcaacaaccaatatcatgatcactaccattataatcgttattatcgtgattctgctaagtctcatcgccgtcggcctgcttttgtactgcaaagcacgctctacaccggtgaccctgagcaaggaccagctctccgggataaacaatatcgctttctcaaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5627 - RNA, 1989 nt, synthetic construct
  misc_feature 1..1989: note = mRNA product Design h-1 comprising derived and/or modified sequence from HRSV(A2)__F_DSCav1_mut5 (opt4)
  source 1..1989: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5628 - RNA, 1989 nt, synthetic construct
  misc_feature 1..1989: note = mRNA product Design h-1 comprising derived and/or modified sequence from HRSV(A2)__F_DSCav1_mut5 (opt5)
  source 1..1989: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcggatgcggcgtttctgtgctgacatttaaggtccttgacctgaagaactacattgataaacaactcctgcctatcctgaataagcagtcctgtagcatttctaacatcgagaccgtgattgagttccagcagaaaaataaccggctcctggaaatcacgcgcgagttttccgtgaatgccggcgtcacaaccccggttagcacatatatgcttaccaactccgaactgctctctctgatcaatgacatgcccattaccaacgatcaaaagaaacttatgagcaacaatgtgcagatcgtgagacagcagtcctacagcattatgtgcatcattaaggaggaagtcctggcttatgtggttcaactccctctgtacggggtgatcgacacaccctgttggaaactgcatacgtctcctctctgcaccacaaacaccaaggagggatccaatatctgtctgacacggaccgatcgcggctggtactgcgacaacgccgggagcgtctctttctttccccaggcggaaacgtgtaaggtgcagagcaatagagttttctgcgatacaatgaactccagaaccctgccttctgaggtgaatctctgcaacgtcgacatttttaatccgaaatatgattgtaagatcatgaccagcaaaacagacgtgtccagctctgtcattacctccctgggagccatcgtgagctgctacggcaagacaaaatgtacggcttctaacaagtgccgggggattatcaagaccttctccaatggatgtgattatgttagcaacaaaggcgtggacacagtctccgtgggcaataccctttactatgttaacaagcaagaggggaaatctctgtacgtgaagggagaacccatcattaatttttatgaccctctcgtcttccccagcgatgagtttgacgcctccatctctcaggtgaacgagaaaattaaccagagcctggctttcatccgcaagtccgatgaactgctccacaatgtgaacgccggcaagagcacaaccaatattatgatcacgaccattatcatcgttattatcgtcattctgctttctctgatcgccgtggggctcctgctgtactgcaaagctagatccacacctgtgacccttagcaaggaccagctctctggaattaacaatatcgcgttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5629 - RNA, 1989 nt, synthetic construct
  misc_feature 1..1989: note = mRNA product Design h-1 comprising derived and/or modified sequence from HRSV(A2)__F_DSCav1_mut5 (opt6)
  source 1..1989: mol_type = other RNA
gggagacccgtgacccggaagttgtacggctacgcgactttccctcccacaaaccctcgcgcccttcctttcctacttgggcccggcagaaagcttaccatggaactattaatacttaaagccaacgcaataacaacaattctcactgctgtcaccttctgcttcgcctcaggccaaaacataacggaagaattttaccaatcaacatgctctgcagtatccaaaggctacctatctgctctaagaacaggttggtatacatcagtaataaccatagaactatcaaacataaaagaaaataaatgcaacggaacagacgcaaaagttaaactcataaaacaagaactagacaaatataaaaacgcagttaccgaactacaactacttatgcaatccactcccgccactggatcaggatcagcaatagcatcaggagtcgcagtatgtaaagtcttacacctcgaaggcgaagtcaataaaatcaaatccgcattactatccacaaacaaagcagtcgtatccctaagcggatgcggagtatcagtactaacatttaaagtactagacctaaaaaattacatcgataaacaactattacctatattaaacaaacaatcctgctccatttcaaatatcgaaaccgtaatagaatttcaacaaaaaaacaacagattactagaaataacaagagaattttccgtaaatgctggcgtaacaacaccagtatccacatacatgctcacaaactccgaactactatcactaataaatgacatgcccataacaaacgatcaaaaaaaactaatgtcaaataatgtacaaatagtaagacaacaaagctactccatcatgtgtataataaaagaagaagtactagcatacgtagttcaactaccactttacggcgtaatcgacaccccttgctggaaactacacacctcccctctatgcaccacaaacacaaaagaaggttccaacatatgccttaccagaacagacagaggctggtattgcgacaacgcaggatcagtttcattttttccacaagctgaaacatgcaaagtacaatcaaacagagtcttctgcgacacaatgaactcaagaactctaccctcagaagtaaacctatgtaacgtagacattttcaaccccaaatacgactgcaaaattatgacatcaaaaacagacgtttcatcatcagttatcacctcattaggagcaatagtaagctgctacggaaaaacaaaatgcaccgcctcaaataaatgcagaggaataataaaaactttctccaacggatgcgactacgtttcaaacaaaggtgtagacactgtatcagtaggaaacacactatattacgtaaataaacaagaaggaaaatcactttatgtcaaaggagaaccaataatcaatttctacgacccattagtattcccatcagacgaatttgatgcttcaatatcacaagtaaacgaaaaaataaatcaatcactcgcatttatacgaaaatcagacgaactactacacaatgtaaacgcaggcaaatcaacaacaaacataatgataacaacaataatcattgtaataatagtaatacttctatctctaatagcagtaggattactcctctactgcaaagcaagatcaacccctgtaacactatcaaaagaccaactttcaggtataaataatatagctttttccaattaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5630 - RNA, 1989 nt, synthetic construct
  misc_feature 1..1989: note = mRNA product Design h-1 comprising derived and/or modified sequence from HRSV(A2)__F_DSCav1_mut5 (opt11)
  source 1..1989: mol_type = other RNA
gggagacccgtgacccggaagttgtacggctacgcgactttccctcccacaaaccctcgcgcccttcctttcctacttgggcccggcagaaagcttaccatggagctcctaatcctcaaagccaacgcgatcactacaatcctcacagccgtcaccttctgcttcgcctccggccaaaacatcaccgaggagttctaccaatcaacctgctccgccgtatcaaaaggatacctaagcgccctacggaccggctggtacacatctgtcatcaccatcgaactatcaaacatcaaagaaaacaaatgcaacggaaccgacgcaaaagtcaaactgattaaacaagaactagacaaatacaaaaacgcagtcaccgaactgcaattactcatgcaaagcacaccggccaccggctcaggcagcgccatcgcctccggcgtcgccgtctgcaaagttctccacctcgagggcgaagtcaacaaaataaaatctgccctcctctccaccaacaaagccgtcgtctccctcagcggctgcggagtctccgtcctcaccttcaaagttctcgatctcaagaactatattgacaaacaacttctacccatactcaacaaacaaagctgcagcatatccaacatcgaaaccgtcatcgagttccaacaaaagaacaaccgcctcctcgaaataacccgcgagttcagcgttaacgccggagtcactacccctgtctccacctacatgctcaccaactccgaactcctatcactaatcaacgacatgcccataaccaacgaccagaagaaactcatgtccaacaacgtccaaattgtccgacaacaaagctactccataatgtgcataataaaagaggaagtcctcgcctacgtcgtacaactgcccctttatggcgtaatcgacacaccctgctggaaactccacacgtcacccctctgcaccaccaacacaaaagaaggctcgaacatctgcctaacacggactgaccgcggctggtactgcgacaacgccggctccgtcagcttcttcccacaagccgaaacctgcaaagtacaatccaaccgagtattctgcgacaccatgaactccagaaccctcccctcagaggtcaacctgtgcaacgtagacatcttcaaccccaaatacgactgcaaaataatgacctcaaaaacagacgtctcctcttccgtaatcaccagcctcggagccatcgtcagctgctacggcaaaaccaaatgcaccgcctcaaacaaatgccgcggcatcatcaaaacattctcaaacggctgcgactacgtctccaacaaaggcgtcgacacagtaagcgtaggcaacacactgtactacgtcaacaaacaagagggaaaatcactctacgtcaaaggagaacccataatcaacttctacgaccccctcgttttccccagcgacgagttcgacgccagcatatcccaagtcaacgagaaaattaaccaatccctagcattcatccgaaaatctgacgaactgctccacaacgtcaacgcgggaaaatcaacaaccaacataatgataaccacaatcataatagtcatcatcgtaatcctcctcagcctaatcgctgtcggcctcctcctctactgcaaagcccgttccaccccagtcacactttccaaggaccaactaagcggaataaacaacatcgcgttctcaaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5631 - RNA, 2205 nt, synthetic construct
  misc_feature 1..2205: note = mRNA product Design h-2 comprising derived and/or modified sequence from HRSV(A2)__F_DSCav1_mut5 (opt1)
  source 1..2205: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5632 - RNA, 2205 nt, synthetic construct
  misc_feature 1..2205: note = mRNA product Design h-2 comprising derived and/or modified sequence from HRSV(A2)__F_DSCav1_mut5 (opt1)
  source 1..2205: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcgggtgcggcgtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggggtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggcgtgatcgacacgccgtgctggaagctgcacaccagccccctctgcaccaccaacacgaaggaggggtccaacatctgcctgacccgcaccgaccggggctggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggggccatcgtgtcctgctacggcaagaccaagtgcaccgccagcaacaagtgccgggggatcatcaagaccttctccaacggctgcgactacgtgagcaacaagggcgtcgacacggtgagcgtggggaacaccctctactacgtcaacaagcaggagggcaagtccctgtacgtgaagggggagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccggcaagtccaccaccaacatcatgatcaccacgatcatcatcgtgatcatcgtcatcctcctgagcctgatcgccgtggggctcctgctgtactgcaaggcccggtccaccccggtgaccctgagcaaggaccagctctccggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5633 - RNA, 2205 nt, synthetic construct
  misc_feature 1..2205: note = mRNA product Design h-2 comprising derived and/or modified sequence from HRSV(A2)__F_DSCav1_mut5 (opt2)
  source 1..2205: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5634 - RNA, 2205 nt, synthetic construct
  misc_feature 1..2205: note = mRNA product Design h-2 comprising derived and/or modified sequence from HRSV(A2)__F_DSCav1_mut5 (opt3)
  source 1..2205: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcggttgcggggtgtccgtattaacttttaaggttctggaccttaagaactacattgataaacaattgctgcctatcctaaataagcagtcatgtagtattagcaacatcgagaccgtgatagagttccagcagaaaaataacaggctcctggaaattacacgggagttttctgtcaatgcgggagtgactaccccagtgtccacatatatgcttaccaactcagaactgttgagcctcatcaatgacatgccgattacgaacgatcaaaagaaactgatgagtaacaatgtccagatcgttcgccagcagtcttactccatcatgtgcattataaaggaggaagtgttagcatatgtagtgcaactgcccctctacggcgtcatcgacactccttgttggaaacttcatacaagcccactgtgcaccactaacacaaaggagggctcgaatatttgtttgacccgaacggatcgtgggtggtactgcgacaacgccggatctgtgtccttctttccccaggctgaaacctgtaaggttcagtcaaatagagtgttctgcgatacaatgaacagtagaactctgcctagcgaggtcaatctctgcaacgtggacatctttaatccaaaatatgattgtaagataatgacctccaaaacagacgtatctagctcagttattaccagtctgggtgccatcgtgtcctgctacggcaagactaaatgtacagcaagcaacaagtgcagggggatcattaagaccttctctaatggatgtgattatgtctcaaacaaaggcgtggacactgtcagtgtgggtaatacgctttactatgttaacaagcaagaggggaaaagcctgtacgtgaagggagaacccatcattaatttttatgaccctttggtattcccatccgatgagtttgacgcttctatatcgcaggtcaacgagaaaatcaaccagagcctcgccttcattcggaagtccgatgaactgttacacaatgtgaacgcgggcaagtcaacaaccaatatcatgatcactaccattataatcgttattatcgtgattctgctaagtctcatcgccgtcggcctgcttttgtactgcaaagcacgctctacaccggtgaccctgagcaaggaccagctctccgggataaacaatatcgctttctcaaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5635 - RNA, 2205 nt, synthetic construct
  misc_feature 1..2205: note = mRNA product Design h-2 comprising derived and/or modified sequence from HRSV(A2)__F_DSCav1_mut5 (opt4)
  source 1..2205: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5636 - RNA, 2205 nt, synthetic construct
  misc_feature 1..2205: note = mRNA product Design h-2 comprising derived and/or modified sequence from HRSV(A2)__F_DSCav1_mut5 (opt5)
  source 1..2205: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcggatgcggcgtttctgtgctgacatttaaggtccttgacctgaagaactacattgataaacaactcctgcctatcctgaataagcagtcctgtagcatttctaacatcgagaccgtgattgagttccagcagaaaaataaccggctcctggaaatcacgcgcgagttttccgtgaatgccggcgtcacaaccccggttagcacatatatgcttaccaactccgaactgctctctctgatcaatgacatgcccattaccaacgatcaaaagaaacttatgagcaacaatgtgcagatcgtgagacagcagtcctacagcattatgtgcatcattaaggaggaagtcctggcttatgtggttcaactccctctgtacggggtgatcgacacaccctgttggaaactgcatacgtctcctctctgcaccacaaacaccaaggagggatccaatatctgtctgacacggaccgatcgcggctggtactgcgacaacgccgggagcgtctctttctttccccaggcggaaacgtgtaaggtgcagagcaatagagttttctgcgatacaatgaactccagaaccctgccttctgaggtgaatctctgcaacgtcgacatttttaatccgaaatatgattgtaagatcatgaccagcaaaacagacgtgtccagctctgtcattacctccctgggagccatcgtgagctgctacggcaagacaaaatgtacggcttctaacaagtgccgggggattatcaagaccttctccaatggatgtgattatgttagcaacaaaggcgtggacacagtctccgtgggcaataccctttactatgttaacaagcaagaggggaaatctctgtacgtgaagggagaacccatcattaatttttatgaccctctcgtcttccccagcgatgagtttgacgcctccatctctcaggtgaacgagaaaattaaccagagcctggctttcatccgcaagtccgatgaactgctccacaatgtgaacgccggcaagagcacaaccaatattatgatcacgaccattatcatcgttattatcgtcattctgctttctctgatcgccgtggggctcctgctgtactgcaaagctagatccacacctgtgacccttagcaaggaccagctctctggaattaacaatatcgcgttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5637 - RNA, 2205 nt, synthetic construct
  misc_feature 1..2205: note = mRNA product Design h-2 comprising derived and/or modified sequence from HRSV(A2)__F_DSCav1_mut5 (opt6)
  source 1..2205: mol_type = other RNA
gggagacccgtgacccggaagttgtacggctacgcgactttccctcccacaaaccctcgcgcccttcctttcctacttgggcccggcagaaagcttaccatggaactattaatacttaaagccaacgcaataacaacaattctcactgctgtcaccttctgcttcgcctcaggccaaaacataacggaagaattttaccaatcaacatgctctgcagtatccaaaggctacctatctgctctaagaacaggttggtatacatcagtaataaccatagaactatcaaacataaaagaaaataaatgcaacggaacagacgcaaaagttaaactcataaaacaagaactagacaaatataaaaacgcagttaccgaactacaactacttatgcaatccactcccgccactggatcaggatcagcaatagcatcaggagtcgcagtatgtaaagtcttacacctcgaaggcgaagtcaataaaatcaaatccgcattactatccacaaacaaagcagtcgtatccctaagcggatgcggagtatcagtactaacatttaaagtactagacctaaaaaattacatcgataaacaactattacctatattaaacaaacaatcctgctccatttcaaatatcgaaaccgtaatagaatttcaacaaaaaaacaacagattactagaaataacaagagaattttccgtaaatgctggcgtaacaacaccagtatccacatacatgctcacaaactccgaactactatcactaataaatgacatgcccataacaaacgatcaaaaaaaactaatgtcaaataatgtacaaatagtaagacaacaaagctactccatcatgtgtataataaaagaagaagtactagcatacgtagttcaactaccactttacggcgtaatcgacaccccttgctggaaactacacacctcccctctatgcaccacaaacacaaaagaaggttccaacatatgccttaccagaacagacagaggctggtattgcgacaacgcaggatcagtttcattttttccacaagctgaaacatgcaaagtacaatcaaacagagtcttctgcgacacaatgaactcaagaactctaccctcagaagtaaacctatgtaacgtagacattttcaaccccaaatacgactgcaaaattatgacatcaaaaacagacgtttcatcatcagttatcacctcattaggagcaatagtaagctgctacggaaaaacaaaatgcaccgcctcaaataaatgcagaggaataataaaaactttctccaacggatgcgactacgtttcaaacaaaggtgtagacactgtatcagtaggaaacacactatattacgtaaataaacaagaaggaaaatcactttatgtcaaaggagaaccaataatcaatttctacgacccattagtattcccatcagacgaatttgatgcttcaatatcacaagtaaacgaaaaaataaatcaatcactcgcatttatacgaaaatcagacgaactactacacaatgtaaacgcaggcaaatcaacaacaaacataatgataacaacaataatcattgtaataatagtaatacttctatctctaatagcagtaggattactcctctactgcaaagcaagatcaacccctgtaacactatcaaaagaccaactttcaggtataaataatatagctttttccaattaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5638 - RNA, 2205 nt, synthetic construct
  misc_feature 1..2205: note = mRNA product Design h-2 comprising derived and/or modified sequence from HRSV(A2)__F_DSCav1_mut5 (opt11)
  source 1..2205: mol_type = other RNA
gggagacccgtgacccggaagttgtacggctacgcgactttccctcccacaaaccctcgcgcccttcctttcctacttgggcccggcagaaagcttaccatggagctcctaatcctcaaagccaacgcgatcactacaatcctcacagccgtcaccttctgcttcgcctccggccaaaacatcaccgaggagttctaccaatcaacctgctccgccgtatcaaaaggatacctaagcgccctacggaccggctggtacacatctgtcatcaccatcgaactatcaaacatcaaagaaaacaaatgcaacggaaccgacgcaaaagtcaaactgattaaacaagaactagacaaatacaaaaacgcagtcaccgaactgcaattactcatgcaaagcacaccggccaccggctcaggcagcgccatcgcctccggcgtcgccgtctgcaaagttctccacctcgagggcgaagtcaacaaaataaaatctgccctcctctccaccaacaaagccgtcgtctccctcagcggctgcggagtctccgtcctcaccttcaaagttctcgatctcaagaactatattgacaaacaacttctacccatactcaacaaacaaagctgcagcatatccaacatcgaaaccgtcatcgagttccaacaaaagaacaaccgcctcctcgaaataacccgcgagttcagcgttaacgccggagtcactacccctgtctccacctacatgctcaccaactccgaactcctatcactaatcaacgacatgcccataaccaacgaccagaagaaactcatgtccaacaacgtccaaattgtccgacaacaaagctactccataatgtgcataataaaagaggaagtcctcgcctacgtcgtacaactgcccctttatggcgtaatcgacacaccctgctggaaactccacacgtcacccctctgcaccaccaacacaaaagaaggctcgaacatctgcctaacacggactgaccgcggctggtactgcgacaacgccggctccgtcagcttcttcccacaagccgaaacctgcaaagtacaatccaaccgagtattctgcgacaccatgaactccagaaccctcccctcagaggtcaacctgtgcaacgtagacatcttcaaccccaaatacgactgcaaaataatgacctcaaaaacagacgtctcctcttccgtaatcaccagcctcggagccatcgtcagctgctacggcaaaaccaaatgcaccgcctcaaacaaatgccgcggcatcatcaaaacattctcaaacggctgcgactacgtctccaacaaaggcgtcgacacagtaagcgtaggcaacacactgtactacgtcaacaaacaagagggaaaatcactctacgtcaaaggagaacccataatcaacttctacgaccccctcgttttccccagcgacgagttcgacgccagcatatcccaagtcaacgagaaaattaaccaatccctagcattcatccgaaaatctgacgaactgctccacaacgtcaacgcgggaaaatcaacaaccaacataatgataaccacaatcataatagtcatcatcgtaatcctcctcagcctaatcgctgtcggcctcctcctctactgcaaagcccgttccaccccagtcacactttccaaggaccaactaagcggaataaacaacatcgcgttctcaaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5639 - RNA, 1985 nt, synthetic construct
  misc_feature 1..1985: note = mRNA product Design h-3 comprising derived and/or modified sequence from HRSV(A2)__F_DSCav1_mut5 (opt1)
  source 1..1985: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5640 - RNA, 1985 nt, synthetic construct
  misc_feature 1..1985: note = mRNA product Design h-3 comprising derived and/or modified sequence from HRSV(A2)__F_DSCav1_mut5 (opt1)
  source 1..1985: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcgggtgcggcgtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggggtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggcgtgatcgacacgccgtgctggaagctgcacaccagccccctctgcaccaccaacacgaaggaggggtccaacatctgcctgacccgcaccgaccggggctggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggggccatcgtgtcctgctacggcaagaccaagtgcaccgccagcaacaagtgccgggggatcatcaagaccttctccaacggctgcgactacgtgagcaacaagggcgtcgacacggtgagcgtggggaacaccctctactacgtcaacaagcaggagggcaagtccctgtacgtgaagggggagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccggcaagtccaccaccaacatcatgatcaccacgatcatcatcgtgatcatcgtcatcctcctgagcctgatcgccgtggggctcctgctgtactgcaaggcccggtccaccccggtgaccctgagcaaggaccagctctccggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5641 - RNA, 1985 nt, synthetic construct
  misc_feature 1..1985: note = mRNA product Design h-3 comprising derived and/or modified sequence from HRSV(A2)__F_DSCav1_mut5 (opt2)
  source 1..1985: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5642 - RNA, 1985 nt, synthetic construct
  misc_feature 1..1985: note = mRNA product Design h-3 comprising derived and/or modified sequence from HRSV(A2)__F_DSCav1_mut5 (opt3)
  source 1..1985: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcggttgcggggtgtccgtattaacttttaaggttctggaccttaagaactacattgataaacaattgctgcctatcctaaataagcagtcatgtagtattagcaacatcgagaccgtgatagagttccagcagaaaaataacaggctcctggaaattacacgggagttttctgtcaatgcgggagtgactaccccagtgtccacatatatgcttaccaactcagaactgttgagcctcatcaatgacatgccgattacgaacgatcaaaagaaactgatgagtaacaatgtccagatcgttcgccagcagtcttactccatcatgtgcattataaaggaggaagtgttagcatatgtagtgcaactgcccctctacggcgtcatcgacactccttgttggaaacttcatacaagcccactgtgcaccactaacacaaaggagggctcgaatatttgtttgacccgaacggatcgtgggtggtactgcgacaacgccggatctgtgtccttctttccccaggctgaaacctgtaaggttcagtcaaatagagtgttctgcgatacaatgaacagtagaactctgcctagcgaggtcaatctctgcaacgtggacatctttaatccaaaatatgattgtaagataatgacctccaaaacagacgtatctagctcagttattaccagtctgggtgccatcgtgtcctgctacggcaagactaaatgtacagcaagcaacaagtgcagggggatcattaagaccttctctaatggatgtgattatgtctcaaacaaaggcgtggacactgtcagtgtgggtaatacgctttactatgttaacaagcaagaggggaaaagcctgtacgtgaagggagaacccatcattaatttttatgaccctttggtattcccatccgatgagtttgacgcttctatatcgcaggtcaacgagaaaatcaaccagagcctcgccttcattcggaagtccgatgaactgttacacaatgtgaacgcgggcaagtcaacaaccaatatcatgatcactaccattataatcgttattatcgtgattctgctaagtctcatcgccgtcggcctgcttttgtactgcaaagcacgctctacaccggtgaccctgagcaaggaccagctctccgggataaacaatatcgctttctcaaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5643 - RNA, 1985 nt, synthetic construct
  misc_feature 1..1985: note = mRNA product Design h-3 comprising derived and/or modified sequence from HRSV(A2)__F_DSCav1_mut5 (opt4)
  source 1..1985: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5644 - RNA, 1985 nt, synthetic construct
  misc_feature 1..1985: note = mRNA product Design h-3 comprising derived and/or modified sequence from HRSV(A2)__F_DSCav1_mut5 (opt5)
  source 1..1985: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcggatgcggcgtttctgtgctgacatttaaggtccttgacctgaagaactacattgataaacaactcctgcctatcctgaataagcagtcctgtagcatttctaacatcgagaccgtgattgagttccagcagaaaaataaccggctcctggaaatcacgcgcgagttttccgtgaatgccggcgtcacaaccccggttagcacatatatgcttaccaactccgaactgctctctctgatcaatgacatgcccattaccaacgatcaaaagaaacttatgagcaacaatgtgcagatcgtgagacagcagtcctacagcattatgtgcatcattaaggaggaagtcctggcttatgtggttcaactccctctgtacggggtgatcgacacaccctgttggaaactgcatacgtctcctctctgcaccacaaacaccaaggagggatccaatatctgtctgacacggaccgatcgcggctggtactgcgacaacgccgggagcgtctctttctttccccaggcggaaacgtgtaaggtgcagagcaatagagttttctgcgatacaatgaactccagaaccctgccttctgaggtgaatctctgcaacgtcgacatttttaatccgaaatatgattgtaagatcatgaccagcaaaacagacgtgtccagctctgtcattacctccctgggagccatcgtgagctgctacggcaagacaaaatgtacggcttctaacaagtgccgggggattatcaagaccttctccaatggatgtgattatgttagcaacaaaggcgtggacacagtctccgtgggcaataccctttactatgttaacaagcaagaggggaaatctctgtacgtgaagggagaacccatcattaatttttatgaccctctcgtcttccccagcgatgagtttgacgcctccatctctcaggtgaacgagaaaattaaccagagcctggctttcatccgcaagtccgatgaactgctccacaatgtgaacgccggcaagagcacaaccaatattatgatcacgaccattatcatcgttattatcgtcattctgctttctctgatcgccgtggggctcctgctgtactgcaaagctagatccacacctgtgacccttagcaaggaccagctctctggaattaacaatatcgcgttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5645 - RNA, 1985 nt, synthetic construct
  misc_feature 1..1985: note = mRNA product Design h-3 comprising derived and/or modified sequence from HRSV(A2)__F_DSCav1_mut5 (opt6)
  source 1..1985: mol_type = other RNA
gggagacccgtgacccggaagttgtacggctacgcgactttccctcccacaaaccctcgcgcccttcctttcctacttgggcccggcagaaagcttaccatggaactattaatacttaaagccaacgcaataacaacaattctcactgctgtcaccttctgcttcgcctcaggccaaaacataacggaagaattttaccaatcaacatgctctgcagtatccaaaggctacctatctgctctaagaacaggttggtatacatcagtaataaccatagaactatcaaacataaaagaaaataaatgcaacggaacagacgcaaaagttaaactcataaaacaagaactagacaaatataaaaacgcagttaccgaactacaactacttatgcaatccactcccgccactggatcaggatcagcaatagcatcaggagtcgcagtatgtaaagtcttacacctcgaaggcgaagtcaataaaatcaaatccgcattactatccacaaacaaagcagtcgtatccctaagcggatgcggagtatcagtactaacatttaaagtactagacctaaaaaattacatcgataaacaactattacctatattaaacaaacaatcctgctccatttcaaatatcgaaaccgtaatagaatttcaacaaaaaaacaacagattactagaaataacaagagaattttccgtaaatgctggcgtaacaacaccagtatccacatacatgctcacaaactccgaactactatcactaataaatgacatgcccataacaaacgatcaaaaaaaactaatgtcaaataatgtacaaatagtaagacaacaaagctactccatcatgtgtataataaaagaagaagtactagcatacgtagttcaactaccactttacggcgtaatcgacaccccttgctggaaactacacacctcccctctatgcaccacaaacacaaaagaaggttccaacatatgccttaccagaacagacagaggctggtattgcgacaacgcaggatcagtttcattttttccacaagctgaaacatgcaaagtacaatcaaacagagtcttctgcgacacaatgaactcaagaactctaccctcagaagtaaacctatgtaacgtagacattttcaaccccaaatacgactgcaaaattatgacatcaaaaacagacgtttcatcatcagttatcacctcattaggagcaatagtaagctgctacggaaaaacaaaatgcaccgcctcaaataaatgcagaggaataataaaaactttctccaacggatgcgactacgtttcaaacaaaggtgtagacactgtatcagtaggaaacacactatattacgtaaataaacaagaaggaaaatcactttatgtcaaaggagaaccaataatcaatttctacgacccattagtattcccatcagacgaatttgatgcttcaatatcacaagtaaacgaaaaaataaatcaatcactcgcatttatacgaaaatcagacgaactactacacaatgtaaacgcaggcaaatcaacaacaaacataatgataacaacaataatcattgtaataatagtaatacttctatctctaatagcagtaggattactcctctactgcaaagcaagatcaacccctgtaacactatcaaaagaccaactttcaggtataaataatatagctttttccaattaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5646 - RNA, 1985 nt, synthetic construct
  misc_feature 1..1985: note = mRNA product Design h-3 comprising derived and/or modified sequence from HRSV(A2)__F_DSCav1_mut5 (opt11)
  source 1..1985: mol_type = other RNA
gggagacccgtgacccggaagttgtacggctacgcgactttccctcccacaaaccctcgcgcccttcctttcctacttgggcccggcagaaagcttaccatggagctcctaatcctcaaagccaacgcgatcactacaatcctcacagccgtcaccttctgcttcgcctccggccaaaacatcaccgaggagttctaccaatcaacctgctccgccgtatcaaaaggatacctaagcgccctacggaccggctggtacacatctgtcatcaccatcgaactatcaaacatcaaagaaaacaaatgcaacggaaccgacgcaaaagtcaaactgattaaacaagaactagacaaatacaaaaacgcagtcaccgaactgcaattactcatgcaaagcacaccggccaccggctcaggcagcgccatcgcctccggcgtcgccgtctgcaaagttctccacctcgagggcgaagtcaacaaaataaaatctgccctcctctccaccaacaaagccgtcgtctccctcagcggctgcggagtctccgtcctcaccttcaaagttctcgatctcaagaactatattgacaaacaacttctacccatactcaacaaacaaagctgcagcatatccaacatcgaaaccgtcatcgagttccaacaaaagaacaaccgcctcctcgaaataacccgcgagttcagcgttaacgccggagtcactacccctgtctccacctacatgctcaccaactccgaactcctatcactaatcaacgacatgcccataaccaacgaccagaagaaactcatgtccaacaacgtccaaattgtccgacaacaaagctactccataatgtgcataataaaagaggaagtcctcgcctacgtcgtacaactgcccctttatggcgtaatcgacacaccctgctggaaactccacacgtcacccctctgcaccaccaacacaaaagaaggctcgaacatctgcctaacacggactgaccgcggctggtactgcgacaacgccggctccgtcagcttcttcccacaagccgaaacctgcaaagtacaatccaaccgagtattctgcgacaccatgaactccagaaccctcccctcagaggtcaacctgtgcaacgtagacatcttcaaccccaaatacgactgcaaaataatgacctcaaaaacagacgtctcctcttccgtaatcaccagcctcggagccatcgtcagctgctacggcaaaaccaaatgcaccgcctcaaacaaatgccgcggcatcatcaaaacattctcaaacggctgcgactacgtctccaacaaaggcgtcgacacagtaagcgtaggcaacacactgtactacgtcaacaaacaagagggaaaatcactctacgtcaaaggagaacccataatcaacttctacgaccccctcgttttccccagcgacgagttcgacgccagcatatcccaagtcaacgagaaaattaaccaatccctagcattcatccgaaaatctgacgaactgctccacaacgtcaacgcgggaaaatcaacaaccaacataatgataaccacaatcataatagtcatcatcgtaatcctcctcagcctaatcgctgtcggcctcctcctctactgcaaagcccgttccaccccagtcacactttccaaggaccaactaagcggaataaacaacatcgcgttctcaaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5647 - RNA, 2048 nt, synthetic construct
  misc_feature 1..2048: note = mRNA product Design h-4 comprising derived and/or modified sequence from HRSV(A2)__F_DSCav1_mut5 (opt1)
  source 1..2048: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5648 - RNA, 2048 nt, synthetic construct
  misc_feature 1..2048: note = mRNA product Design h-4 comprising derived and/or modified sequence from HRSV(A2)__F_DSCav1_mut5 (opt1)
  source 1..2048: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcgggtgcggcgtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggggtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggcgtgatcgacacgccgtgctggaagctgcacaccagccccctctgcaccaccaacacgaaggaggggtccaacatctgcctgacccgcaccgaccggggctggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggggccatcgtgtcctgctacggcaagaccaagtgcaccgccagcaacaagtgccgggggatcatcaagaccttctccaacggctgcgactacgtgagcaacaagggcgtcgacacggtgagcgtggggaacaccctctactacgtcaacaagcaggagggcaagtccctgtacgtgaagggggagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccggcaagtccaccaccaacatcatgatcaccacgatcatcatcgtgatcatcgtcatcctcctgagcctgatcgccgtggggctcctgctgtactgcaaggcccggtccaccccggtgaccctgagcaaggaccagctctccggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5649 - RNA, 2048 nt, synthetic construct
  misc_feature 1..2048: note = mRNA product Design h-4 comprising derived and/or modified sequence from HRSV(A2)__F_DSCav1_mut5 (opt2)
  source 1..2048: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5650 - RNA, 2048 nt, synthetic construct
  misc_feature 1..2048: note = mRNA product Design h-4 comprising derived and/or modified sequence from HRSV(A2)__F_DSCav1_mut5 (opt3)
  source 1..2048: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcggttgcggggtgtccgtattaacttttaaggttctggaccttaagaactacattgataaacaattgctgcctatcctaaataagcagtcatgtagtattagcaacatcgagaccgtgatagagttccagcagaaaaataacaggctcctggaaattacacgggagttttctgtcaatgcgggagtgactaccccagtgtccacatatatgcttaccaactcagaactgttgagcctcatcaatgacatgccgattacgaacgatcaaaagaaactgatgagtaacaatgtccagatcgttcgccagcagtcttactccatcatgtgcattataaaggaggaagtgttagcatatgtagtgcaactgcccctctacggcgtcatcgacactccttgttggaaacttcatacaagcccactgtgcaccactaacacaaaggagggctcgaatatttgtttgacccgaacggatcgtgggtggtactgcgacaacgccggatctgtgtccttctttccccaggctgaaacctgtaaggttcagtcaaatagagtgttctgcgatacaatgaacagtagaactctgcctagcgaggtcaatctctgcaacgtggacatctttaatccaaaatatgattgtaagataatgacctccaaaacagacgtatctagctcagttattaccagtctgggtgccatcgtgtcctgctacggcaagactaaatgtacagcaagcaacaagtgcagggggatcattaagaccttctctaatggatgtgattatgtctcaaacaaaggcgtggacactgtcagtgtgggtaatacgctttactatgttaacaagcaagaggggaaaagcctgtacgtgaagggagaacccatcattaatttttatgaccctttggtattcccatccgatgagtttgacgcttctatatcgcaggtcaacgagaaaatcaaccagagcctcgccttcattcggaagtccgatgaactgttacacaatgtgaacgcgggcaagtcaacaaccaatatcatgatcactaccattataatcgttattatcgtgattctgctaagtctcatcgccgtcggcctgcttttgtactgcaaagcacgctctacaccggtgaccctgagcaaggaccagctctccgggataaacaatatcgctttctcaaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5651 - RNA, 2048 nt, synthetic construct
  misc_feature 1..2048: note = mRNA product Design h-4 comprising derived and/or modified sequence from HRSV(A2)__F_DSCav1_mut5 (opt4)
  source 1..2048: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5652 - RNA, 2048 nt, synthetic construct
  misc_feature 1..2048: note = mRNA product Design h-4 comprising derived and/or modified sequence from HRSV(A2)__F_DSCav1_mut5 (opt5)
  source 1..2048: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcggatgcggcgtttctgtgctgacatttaaggtccttgacctgaagaactacattgataaacaactcctgcctatcctgaataagcagtcctgtagcatttctaacatcgagaccgtgattgagttccagcagaaaaataaccggctcctggaaatcacgcgcgagttttccgtgaatgccggcgtcacaaccccggttagcacatatatgcttaccaactccgaactgctctctctgatcaatgacatgcccattaccaacgatcaaaagaaacttatgagcaacaatgtgcagatcgtgagacagcagtcctacagcattatgtgcatcattaaggaggaagtcctggcttatgtggttcaactccctctgtacggggtgatcgacacaccctgttggaaactgcatacgtctcctctctgcaccacaaacaccaaggagggatccaatatctgtctgacacggaccgatcgcggctggtactgcgacaacgccgggagcgtctctttctttccccaggcggaaacgtgtaaggtgcagagcaatagagttttctgcgatacaatgaactccagaaccctgccttctgaggtgaatctctgcaacgtcgacatttttaatccgaaatatgattgtaagatcatgaccagcaaaacagacgtgtccagctctgtcattacctccctgggagccatcgtgagctgctacggcaagacaaaatgtacggcttctaacaagtgccgggggattatcaagaccttctccaatggatgtgattatgttagcaacaaaggcgtggacacagtctccgtgggcaataccctttactatgttaacaagcaagaggggaaatctctgtacgtgaagggagaacccatcattaatttttatgaccctctcgtcttccccagcgatgagtttgacgcctccatctctcaggtgaacgagaaaattaaccagagcctggctttcatccgcaagtccgatgaactgctccacaatgtgaacgccggcaagagcacaaccaatattatgatcacgaccattatcatcgttattatcgtcattctgctttctctgatcgccgtggggctcctgctgtactgcaaagctagatccacacctgtgacccttagcaaggaccagctctctggaattaacaatatcgcgttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5653 - RNA, 2048 nt, synthetic construct
  misc_feature 1..2048: note = mRNA product Design h-4 comprising derived and/or modified sequence from HRSV(A2)__F_DSCav1_mut5 (opt6)
  source 1..2048: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactattaatacttaaagccaacgcaataacaacaattctcactgctgtcaccttctgcttcgcctcaggccaaaacataacggaagaattttaccaatcaacatgctctgcagtatccaaaggctacctatctgctctaagaacaggttggtatacatcagtaataaccatagaactatcaaacataaaagaaaataaatgcaacggaacagacgcaaaagttaaactcataaaacaagaactagacaaatataaaaacgcagttaccgaactacaactacttatgcaatccactcccgccactggatcaggatcagcaatagcatcaggagtcgcagtatgtaaagtcttacacctcgaaggcgaagtcaataaaatcaaatccgcattactatccacaaacaaagcagtcgtatccctaagcggatgcggagtatcagtactaacatttaaagtactagacctaaaaaattacatcgataaacaactattacctatattaaacaaacaatcctgctccatttcaaatatcgaaaccgtaatagaatttcaacaaaaaaacaacagattactagaaataacaagagaattttccgtaaatgctggcgtaacaacaccagtatccacatacatgctcacaaactccgaactactatcactaataaatgacatgcccataacaaacgatcaaaaaaaactaatgtcaaataatgtacaaatagtaagacaacaaagctactccatcatgtgtataataaaagaagaagtactagcatacgtagttcaactaccactttacggcgtaatcgacaccccttgctggaaactacacacctcccctctatgcaccacaaacacaaaagaaggttccaacatatgccttaccagaacagacagaggctggtattgcgacaacgcaggatcagtttcattttttccacaagctgaaacatgcaaagtacaatcaaacagagtcttctgcgacacaatgaactcaagaactctaccctcagaagtaaacctatgtaacgtagacattttcaaccccaaatacgactgcaaaattatgacatcaaaaacagacgtttcatcatcagttatcacctcattaggagcaatagtaagctgctacggaaaaacaaaatgcaccgcctcaaataaatgcagaggaataataaaaactttctccaacggatgcgactacgtttcaaacaaaggtgtagacactgtatcagtaggaaacacactatattacgtaaataaacaagaaggaaaatcactttatgtcaaaggagaaccaataatcaatttctacgacccattagtattcccatcagacgaatttgatgcttcaatatcacaagtaaacgaaaaaataaatcaatcactcgcatttatacgaaaatcagacgaactactacacaatgtaaacgcaggcaaatcaacaacaaacataatgataacaacaataatcattgtaataatagtaatacttctatctctaatagcagtaggattactcctctactgcaaagcaagatcaacccctgtaacactatcaaaagaccaactttcaggtataaataatatagctttttccaattaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5654 - RNA, 2048 nt, synthetic construct
  misc_feature 1..2048: note = mRNA product Design h-4 comprising derived and/or modified sequence from HRSV(A2)__F_DSCav1_mut5 (opt11)
  source 1..2048: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctaatcctcaaagccaacgcgatcactacaatcctcacagccgtcaccttctgcttcgcctccggccaaaacatcaccgaggagttctaccaatcaacctgctccgccgtatcaaaaggatacctaagcgccctacggaccggctggtacacatctgtcatcaccatcgaactatcaaacatcaaagaaaacaaatgcaacggaaccgacgcaaaagtcaaactgattaaacaagaactagacaaatacaaaaacgcagtcaccgaactgcaattactcatgcaaagcacaccggccaccggctcaggcagcgccatcgcctccggcgtcgccgtctgcaaagttctccacctcgagggcgaagtcaacaaaataaaatctgccctcctctccaccaacaaagccgtcgtctccctcagcggctgcggagtctccgtcctcaccttcaaagttctcgatctcaagaactatattgacaaacaacttctacccatactcaacaaacaaagctgcagcatatccaacatcgaaaccgtcatcgagttccaacaaaagaacaaccgcctcctcgaaataacccgcgagttcagcgttaacgccggagtcactacccctgtctccacctacatgctcaccaactccgaactcctatcactaatcaacgacatgcccataaccaacgaccagaagaaactcatgtccaacaacgtccaaattgtccgacaacaaagctactccataatgtgcataataaaagaggaagtcctcgcctacgtcgtacaactgcccctttatggcgtaatcgacacaccctgctggaaactccacacgtcacccctctgcaccaccaacacaaaagaaggctcgaacatctgcctaacacggactgaccgcggctggtactgcgacaacgccggctccgtcagcttcttcccacaagccgaaacctgcaaagtacaatccaaccgagtattctgcgacaccatgaactccagaaccctcccctcagaggtcaacctgtgcaacgtagacatcttcaaccccaaatacgactgcaaaataatgacctcaaaaacagacgtctcctcttccgtaatcaccagcctcggagccatcgtcagctgctacggcaaaaccaaatgcaccgcctcaaacaaatgccgcggcatcatcaaaacattctcaaacggctgcgactacgtctccaacaaaggcgtcgacacagtaagcgtaggcaacacactgtactacgtcaacaaacaagagggaaaatcactctacgtcaaaggagaacccataatcaacttctacgaccccctcgttttccccagcgacgagttcgacgccagcatatcccaagtcaacgagaaaattaaccaatccctagcattcatccgaaaatctgacgaactgctccacaacgtcaacgcgggaaaatcaacaaccaacataatgataaccacaatcataatagtcatcatcgtaatcctcctcagcctaatcgctgtcggcctcctcctctactgcaaagcccgttccaccccagtcacactttccaaggaccaactaagcggaataaacaacatcgcgttctcaaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5655 - RNA, 2064 nt, synthetic construct
  misc_feature 1..2064: note = mRNA product Design h-5 comprising derived and/or modified sequence from HRSV(A2)__F_DSCav1_mut5 (opt1)
  source 1..2064: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5656 - RNA, 2064 nt, synthetic construct
  misc_feature 1..2064: note = mRNA product Design h-5 comprising derived and/or modified sequence from HRSV(A2)__F_DSCav1_mut5 (opt1)
  source 1..2064: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcgggtgcggcgtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggggtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggcgtgatcgacacgccgtgctggaagctgcacaccagccccctctgcaccaccaacacgaaggaggggtccaacatctgcctgacccgcaccgaccggggctggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggggccatcgtgtcctgctacggcaagaccaagtgcaccgccagcaacaagtgccgggggatcatcaagaccttctccaacggctgcgactacgtgagcaacaagggcgtcgacacggtgagcgtggggaacaccctctactacgtcaacaagcaggagggcaagtccctgtacgtgaagggggagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccggcaagtccaccaccaacatcatgatcaccacgatcatcatcgtgatcatcgtcatcctcctgagcctgatcgccgtggggctcctgctgtactgcaaggcccggtccaccccggtgaccctgagcaaggaccagctctccggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5657 - RNA, 2064 nt, synthetic construct
  misc_feature 1..2064: note = mRNA product Design h-5 comprising derived and/or modified sequence from HRSV(A2)__F_DSCav1_mut5 (opt2)
  source 1..2064: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5658 - RNA, 2064 nt, synthetic construct
  misc_feature 1..2064: note = mRNA product Design h-5 comprising derived and/or modified sequence from HRSV(A2)__F_DSCav1_mut5 (opt3)
  source 1..2064: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcggttgcggggtgtccgtattaacttttaaggttctggaccttaagaactacattgataaacaattgctgcctatcctaaataagcagtcatgtagtattagcaacatcgagaccgtgatagagttccagcagaaaaataacaggctcctggaaattacacgggagttttctgtcaatgcgggagtgactaccccagtgtccacatatatgcttaccaactcagaactgttgagcctcatcaatgacatgccgattacgaacgatcaaaagaaactgatgagtaacaatgtccagatcgttcgccagcagtcttactccatcatgtgcattataaaggaggaagtgttagcatatgtagtgcaactgcccctctacggcgtcatcgacactccttgttggaaacttcatacaagcccactgtgcaccactaacacaaaggagggctcgaatatttgtttgacccgaacggatcgtgggtggtactgcgacaacgccggatctgtgtccttctttccccaggctgaaacctgtaaggttcagtcaaatagagtgttctgcgatacaatgaacagtagaactctgcctagcgaggtcaatctctgcaacgtggacatctttaatccaaaatatgattgtaagataatgacctccaaaacagacgtatctagctcagttattaccagtctgggtgccatcgtgtcctgctacggcaagactaaatgtacagcaagcaacaagtgcagggggatcattaagaccttctctaatggatgtgattatgtctcaaacaaaggcgtggacactgtcagtgtgggtaatacgctttactatgttaacaagcaagaggggaaaagcctgtacgtgaagggagaacccatcattaatttttatgaccctttggtattcccatccgatgagtttgacgcttctatatcgcaggtcaacgagaaaatcaaccagagcctcgccttcattcggaagtccgatgaactgttacacaatgtgaacgcgggcaagtcaacaaccaatatcatgatcactaccattataatcgttattatcgtgattctgctaagtctcatcgccgtcggcctgcttttgtactgcaaagcacgctctacaccggtgaccctgagcaaggaccagctctccgggataaacaatatcgctttctcaaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5659 - RNA, 2064 nt, synthetic construct
  misc_feature 1..2064: note = mRNA product Design h-5 comprising derived and/or modified sequence from HRSV(A2)__F_DSCav1_mut5 (opt4)
  source 1..2064: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5660 - RNA, 2064 nt, synthetic construct
  misc_feature 1..2064: note = mRNA product Design h-5 comprising derived and/or modified sequence from HRSV(A2)__F_DSCav1_mut5 (opt5)
  source 1..2064: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcggatgcggcgtttctgtgctgacatttaaggtccttgacctgaagaactacattgataaacaactcctgcctatcctgaataagcagtcctgtagcatttctaacatcgagaccgtgattgagttccagcagaaaaataaccggctcctggaaatcacgcgcgagttttccgtgaatgccggcgtcacaaccccggttagcacatatatgcttaccaactccgaactgctctctctgatcaatgacatgcccattaccaacgatcaaaagaaacttatgagcaacaatgtgcagatcgtgagacagcagtcctacagcattatgtgcatcattaaggaggaagtcctggcttatgtggttcaactccctctgtacggggtgatcgacacaccctgttggaaactgcatacgtctcctctctgcaccacaaacaccaaggagggatccaatatctgtctgacacggaccgatcgcggctggtactgcgacaacgccgggagcgtctctttctttccccaggcggaaacgtgtaaggtgcagagcaatagagttttctgcgatacaatgaactccagaaccctgccttctgaggtgaatctctgcaacgtcgacatttttaatccgaaatatgattgtaagatcatgaccagcaaaacagacgtgtccagctctgtcattacctccctgggagccatcgtgagctgctacggcaagacaaaatgtacggcttctaacaagtgccgggggattatcaagaccttctccaatggatgtgattatgttagcaacaaaggcgtggacacagtctccgtgggcaataccctttactatgttaacaagcaagaggggaaatctctgtacgtgaagggagaacccatcattaatttttatgaccctctcgtcttccccagcgatgagtttgacgcctccatctctcaggtgaacgagaaaattaaccagagcctggctttcatccgcaagtccgatgaactgctccacaatgtgaacgccggcaagagcacaaccaatattatgatcacgaccattatcatcgttattatcgtcattctgctttctctgatcgccgtggggctcctgctgtactgcaaagctagatccacacctgtgacccttagcaaggaccagctctctggaattaacaatatcgcgttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5661 - RNA, 2064 nt, synthetic construct
  misc_feature 1..2064: note = mRNA product Design h-5 comprising derived and/or modified sequence from HRSV(A2)__F_DSCav1_mut5 (opt6)
  source 1..2064: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactattaatacttaaagccaacgcaataacaacaattctcactgctgtcaccttctgcttcgcctcaggccaaaacataacggaagaattttaccaatcaacatgctctgcagtatccaaaggctacctatctgctctaagaacaggttggtatacatcagtaataaccatagaactatcaaacataaaagaaaataaatgcaacggaacagacgcaaaagttaaactcataaaacaagaactagacaaatataaaaacgcagttaccgaactacaactacttatgcaatccactcccgccactggatcaggatcagcaatagcatcaggagtcgcagtatgtaaagtcttacacctcgaaggcgaagtcaataaaatcaaatccgcattactatccacaaacaaagcagtcgtatccctaagcggatgcggagtatcagtactaacatttaaagtactagacctaaaaaattacatcgataaacaactattacctatattaaacaaacaatcctgctccatttcaaatatcgaaaccgtaatagaatttcaacaaaaaaacaacagattactagaaataacaagagaattttccgtaaatgctggcgtaacaacaccagtatccacatacatgctcacaaactccgaactactatcactaataaatgacatgcccataacaaacgatcaaaaaaaactaatgtcaaataatgtacaaatagtaagacaacaaagctactccatcatgtgtataataaaagaagaagtactagcatacgtagttcaactaccactttacggcgtaatcgacaccccttgctggaaactacacacctcccctctatgcaccacaaacacaaaagaaggttccaacatatgccttaccagaacagacagaggctggtattgcgacaacgcaggatcagtttcattttttccacaagctgaaacatgcaaagtacaatcaaacagagtcttctgcgacacaatgaactcaagaactctaccctcagaagtaaacctatgtaacgtagacattttcaaccccaaatacgactgcaaaattatgacatcaaaaacagacgtttcatcatcagttatcacctcattaggagcaatagtaagctgctacggaaaaacaaaatgcaccgcctcaaataaatgcagaggaataataaaaactttctccaacggatgcgactacgtttcaaacaaaggtgtagacactgtatcagtaggaaacacactatattacgtaaataaacaagaaggaaaatcactttatgtcaaaggagaaccaataatcaatttctacgacccattagtattcccatcagacgaatttgatgcttcaatatcacaagtaaacgaaaaaataaatcaatcactcgcatttatacgaaaatcagacgaactactacacaatgtaaacgcaggcaaatcaacaacaaacataatgataacaacaataatcattgtaataatagtaatacttctatctctaatagcagtaggattactcctctactgcaaagcaagatcaacccctgtaacactatcaaaagaccaactttcaggtataaataatatagctttttccaattaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5662 - RNA, 2064 nt, synthetic construct
  misc_feature 1..2064: note = mRNA product Design h-5 comprising derived and/or modified sequence from HRSV(A2)__F_DSCav1_mut5 (opt11)
  source 1..2064: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctaatcctcaaagccaacgcgatcactacaatcctcacagccgtcaccttctgcttcgcctccggccaaaacatcaccgaggagttctaccaatcaacctgctccgccgtatcaaaaggatacctaagcgccctacggaccggctggtacacatctgtcatcaccatcgaactatcaaacatcaaagaaaacaaatgcaacggaaccgacgcaaaagtcaaactgattaaacaagaactagacaaatacaaaaacgcagtcaccgaactgcaattactcatgcaaagcacaccggccaccggctcaggcagcgccatcgcctccggcgtcgccgtctgcaaagttctccacctcgagggcgaagtcaacaaaataaaatctgccctcctctccaccaacaaagccgtcgtctccctcagcggctgcggagtctccgtcctcaccttcaaagttctcgatctcaagaactatattgacaaacaacttctacccatactcaacaaacaaagctgcagcatatccaacatcgaaaccgtcatcgagttccaacaaaagaacaaccgcctcctcgaaataacccgcgagttcagcgttaacgccggagtcactacccctgtctccacctacatgctcaccaactccgaactcctatcactaatcaacgacatgcccataaccaacgaccagaagaaactcatgtccaacaacgtccaaattgtccgacaacaaagctactccataatgtgcataataaaagaggaagtcctcgcctacgtcgtacaactgcccctttatggcgtaatcgacacaccctgctggaaactccacacgtcacccctctgcaccaccaacacaaaagaaggctcgaacatctgcctaacacggactgaccgcggctggtactgcgacaacgccggctccgtcagcttcttcccacaagccgaaacctgcaaagtacaatccaaccgagtattctgcgacaccatgaactccagaaccctcccctcagaggtcaacctgtgcaacgtagacatcttcaaccccaaatacgactgcaaaataatgacctcaaaaacagacgtctcctcttccgtaatcaccagcctcggagccatcgtcagctgctacggcaaaaccaaatgcaccgcctcaaacaaatgccgcggcatcatcaaaacattctcaaacggctgcgactacgtctccaacaaaggcgtcgacacagtaagcgtaggcaacacactgtactacgtcaacaaacaagagggaaaatcactctacgtcaaaggagaacccataatcaacttctacgaccccctcgttttccccagcgacgagttcgacgccagcatatcccaagtcaacgagaaaattaaccaatccctagcattcatccgaaaatctgacgaactgctccacaacgtcaacgcgggaaaatcaacaaccaacataatgataaccacaatcataatagtcatcatcgtaatcctcctcagcctaatcgctgtcggcctcctcctctactgcaaagcccgttccaccccagtcacactttccaaggaccaactaagcggaataaacaacatcgcgttctcaaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5663 - RNA, 1997 nt, synthetic construct
  misc_feature 1..1997: note = mRNA product Design i-1 comprising derived and/or modified sequence from HRSV(A2)__F_DSCav1_mut5 (opt1)
  source 1..1997: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5664 - RNA, 1997 nt, synthetic construct
  misc_feature 1..1997: note = mRNA product Design i-1 comprising derived and/or modified sequence from HRSV(A2)__F_DSCav1_mut5 (opt1)
  source 1..1997: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcgggtgcggcgtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggggtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggcgtgatcgacacgccgtgctggaagctgcacaccagccccctctgcaccaccaacacgaaggaggggtccaacatctgcctgacccgcaccgaccggggctggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggggccatcgtgtcctgctacggcaagaccaagtgcaccgccagcaacaagtgccgggggatcatcaagaccttctccaacggctgcgactacgtgagcaacaagggcgtcgacacggtgagcgtggggaacaccctctactacgtcaacaagcaggagggcaagtccctgtacgtgaagggggagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccggcaagtccaccaccaacatcatgatcaccacgatcatcatcgtgatcatcgtcatcctcctgagcctgatcgccgtggggctcctgctgtactgcaaggcccggtccaccccggtgaccctgagcaaggaccagctctccggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5665 - RNA, 1997 nt, synthetic construct
  misc_feature 1..1997: note = mRNA product Design i-1 comprising derived and/or modified sequence from HRSV(A2)__F_DSCav1_mut5 (opt2)
  source 1..1997: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5666 - RNA, 1997 nt, synthetic construct
  misc_feature 1..1997: note = mRNA product Design i-1 comprising derived and/or modified sequence from HRSV(A2)__F_DSCav1_mut5 (opt3)
  source 1..1997: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcggttgcggggtgtccgtattaacttttaaggttctggaccttaagaactacattgataaacaattgctgcctatcctaaataagcagtcatgtagtattagcaacatcgagaccgtgatagagttccagcagaaaaataacaggctcctggaaattacacgggagttttctgtcaatgcgggagtgactaccccagtgtccacatatatgcttaccaactcagaactgttgagcctcatcaatgacatgccgattacgaacgatcaaaagaaactgatgagtaacaatgtccagatcgttcgccagcagtcttactccatcatgtgcattataaaggaggaagtgttagcatatgtagtgcaactgcccctctacggcgtcatcgacactccttgttggaaacttcatacaagcccactgtgcaccactaacacaaaggagggctcgaatatttgtttgacccgaacggatcgtgggtggtactgcgacaacgccggatctgtgtccttctttccccaggctgaaacctgtaaggttcagtcaaatagagtgttctgcgatacaatgaacagtagaactctgcctagcgaggtcaatctctgcaacgtggacatctttaatccaaaatatgattgtaagataatgacctccaaaacagacgtatctagctcagttattaccagtctgggtgccatcgtgtcctgctacggcaagactaaatgtacagcaagcaacaagtgcagggggatcattaagaccttctctaatggatgtgattatgtctcaaacaaaggcgtggacactgtcagtgtgggtaatacgctttactatgttaacaagcaagaggggaaaagcctgtacgtgaagggagaacccatcattaatttttatgaccctttggtattcccatccgatgagtttgacgcttctatatcgcaggtcaacgagaaaatcaaccagagcctcgccttcattcggaagtccgatgaactgttacacaatgtgaacgcgggcaagtcaacaaccaatatcatgatcactaccattataatcgttattatcgtgattctgctaagtctcatcgccgtcggcctgcttttgtactgcaaagcacgctctacaccggtgaccctgagcaaggaccagctctccgggataaacaatatcgctttctcaaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5667 - RNA, 1997 nt, synthetic construct
  misc_feature 1..1997: note = mRNA product Design i-1 comprising derived and/or modified sequence from HRSV(A2)__F_DSCav1_mut5 (opt4)
  source 1..1997: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5668 - RNA, 1997 nt, synthetic construct
  misc_feature 1..1997: note = mRNA product Design i-1 comprising derived and/or modified sequence from HRSV(A2)__F_DSCav1_mut5 (opt5)
  source 1..1997: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcggatgcggcgtttctgtgctgacatttaaggtccttgacctgaagaactacattgataaacaactcctgcctatcctgaataagcagtcctgtagcatttctaacatcgagaccgtgattgagttccagcagaaaaataaccggctcctggaaatcacgcgcgagttttccgtgaatgccggcgtcacaaccccggttagcacatatatgcttaccaactccgaactgctctctctgatcaatgacatgcccattaccaacgatcaaaagaaacttatgagcaacaatgtgcagatcgtgagacagcagtcctacagcattatgtgcatcattaaggaggaagtcctggcttatgtggttcaactccctctgtacggggtgatcgacacaccctgttggaaactgcatacgtctcctctctgcaccacaaacaccaaggagggatccaatatctgtctgacacggaccgatcgcggctggtactgcgacaacgccgggagcgtctctttctttccccaggcggaaacgtgtaaggtgcagagcaatagagttttctgcgatacaatgaactccagaaccctgccttctgaggtgaatctctgcaacgtcgacatttttaatccgaaatatgattgtaagatcatgaccagcaaaacagacgtgtccagctctgtcattacctccctgggagccatcgtgagctgctacggcaagacaaaatgtacggcttctaacaagtgccgggggattatcaagaccttctccaatggatgtgattatgttagcaacaaaggcgtggacacagtctccgtgggcaataccctttactatgttaacaagcaagaggggaaatctctgtacgtgaagggagaacccatcattaatttttatgaccctctcgtcttccccagcgatgagtttgacgcctccatctctcaggtgaacgagaaaattaaccagagcctggctttcatccgcaagtccgatgaactgctccacaatgtgaacgccggcaagagcacaaccaatattatgatcacgaccattatcatcgttattatcgtcattctgctttctctgatcgccgtggggctcctgctgtactgcaaagctagatccacacctgtgacccttagcaaggaccagctctctggaattaacaatatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5669 - RNA, 1997 nt, synthetic construct
  misc_feature 1..1997: note = mRNA product Design i-1 comprising derived and/or modified sequence from HRSV(A2)__F_DSCav1_mut5 (opt6)
  source 1..1997: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactattaatacttaaagccaacgcaataacaacaattctcactgctgtcaccttctgcttcgcctcaggccaaaacataacggaagaattttaccaatcaacatgctctgcagtatccaaaggctacctatctgctctaagaacaggttggtatacatcagtaataaccatagaactatcaaacataaaagaaaataaatgcaacggaacagacgcaaaagttaaactcataaaacaagaactagacaaatataaaaacgcagttaccgaactacaactacttatgcaatccactcccgccactggatcaggatcagcaatagcatcaggagtcgcagtatgtaaagtcttacacctcgaaggcgaagtcaataaaatcaaatccgcattactatccacaaacaaagcagtcgtatccctaagcggatgcggagtatcagtactaacatttaaagtactagacctaaaaaattacatcgataaacaactattacctatattaaacaaacaatcctgctccatttcaaatatcgaaaccgtaatagaatttcaacaaaaaaacaacagattactagaaataacaagagaattttccgtaaatgctggcgtaacaacaccagtatccacatacatgctcacaaactccgaactactatcactaataaatgacatgcccataacaaacgatcaaaaaaaactaatgtcaaataatgtacaaatagtaagacaacaaagctactccatcatgtgtataataaaagaagaagtactagcatacgtagttcaactaccactttacggcgtaatcgacaccccttgctggaaactacacacctcccctctatgcaccacaaacacaaaagaaggttccaacatatgccttaccagaacagacagaggctggtattgcgacaacgcaggatcagtttcattttttccacaagctgaaacatgcaaagtacaatcaaacagagtcttctgcgacacaatgaactcaagaactctaccctcagaagtaaacctatgtaacgtagacattttcaaccccaaatacgactgcaaaattatgacatcaaaaacagacgtttcatcatcagttatcacctcattaggagcaatagtaagctgctacggaaaaacaaaatgcaccgcctcaaataaatgcagaggaataataaaaactttctccaacggatgcgactacgtttcaaacaaaggtgtagacactgtatcagtaggaaacacactatattacgtaaataaacaagaaggaaaatcactttatgtcaaaggagaaccaataatcaatttctacgacccattagtattcccatcagacgaatttgatgcttcaatatcacaagtaaacgaaaaaataaatcaatcactcgcatttatacgaaaatcagacgaactactacacaatgtaaacgcaggcaaatcaacaacaaacataatgataacaacaataatcattgtaataatagtaatacttctatctctaatagcagtaggattactcctctactgcaaagcaagatcaacccctgtaacactatcaaaagaccaactttcaggtataaataatatagctttttccaattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5670 - RNA, 1997 nt, synthetic construct
  misc_feature 1..1997: note = mRNA product Design i-1 comprising derived and/or modified sequence from HRSV(A2)__F_DSCav1_mut5 (opt11)
  source 1..1997: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctaatcctcaaagccaacgcgatcactacaatcctcacagccgtcaccttctgcttcgcctccggccaaaacatcaccgaggagttctaccaatcaacctgctccgccgtatcaaaaggatacctaagcgccctacggaccggctggtacacatctgtcatcaccatcgaactatcaaacatcaaagaaaacaaatgcaacggaaccgacgcaaaagtcaaactgattaaacaagaactagacaaatacaaaaacgcagtcaccgaactgcaattactcatgcaaagcacaccggccaccggctcaggcagcgccatcgcctccggcgtcgccgtctgcaaagttctccacctcgagggcgaagtcaacaaaataaaatctgccctcctctccaccaacaaagccgtcgtctccctcagcggctgcggagtctccgtcctcaccttcaaagttctcgatctcaagaactatattgacaaacaacttctacccatactcaacaaacaaagctgcagcatatccaacatcgaaaccgtcatcgagttccaacaaaagaacaaccgcctcctcgaaataacccgcgagttcagcgttaacgccggagtcactacccctgtctccacctacatgctcaccaactccgaactcctatcactaatcaacgacatgcccataaccaacgaccagaagaaactcatgtccaacaacgtccaaattgtccgacaacaaagctactccataatgtgcataataaaagaggaagtcctcgcctacgtcgtacaactgcccctttatggcgtaatcgacacaccctgctggaaactccacacgtcacccctctgcaccaccaacacaaaagaaggctcgaacatctgcctaacacggactgaccgcggctggtactgcgacaacgccggctccgtcagcttcttcccacaagccgaaacctgcaaagtacaatccaaccgagtattctgcgacaccatgaactccagaaccctcccctcagaggtcaacctgtgcaacgtagacatcttcaaccccaaatacgactgcaaaataatgacctcaaaaacagacgtctcctcttccgtaatcaccagcctcggagccatcgtcagctgctacggcaaaaccaaatgcaccgcctcaaacaaatgccgcggcatcatcaaaacattctcaaacggctgcgactacgtctccaacaaaggcgtcgacacagtaagcgtaggcaacacactgtactacgtcaacaaacaagagggaaaatcactctacgtcaaaggagaacccataatcaacttctacgaccccctcgttttccccagcgacgagttcgacgccagcatatcccaagtcaacgagaaaattaaccaatccctagcattcatccgaaaatctgacgaactgctccacaacgtcaacgcgggaaaatcaacaaccaacataatgataaccacaatcataatagtcatcatcgtaatcctcctcagcctaatcgctgtcggcctcctcctctactgcaaagcccgttccaccccagtcacactttccaaggaccaactaagcggaataaacaacatcgcgttctcaaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5671 - RNA, 1997 nt, synthetic construct
  misc_feature 1..1997: note = mRNA product Design i-2 comprising derived and/or modified sequence from HRSV(A2)__F_DSCav1_mut5 (opt1)
  source 1..1997: mol_type = other RNA
gggagaggcgctgcctacggaggtggcagccatctccttctcggcatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5672 - RNA, 1997 nt, synthetic construct
  misc_feature 1..1997: note = mRNA product Design i-2 comprising derived and/or modified sequence from HRSV(A2)__F_DSCav1_mut5 (opt1)
  source 1..1997: mol_type = other RNA
gggagaggcgctgcctacggaggtggcagccatctccttctcggcatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcgggtgcggcgtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggggtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggcgtgatcgacacgccgtgctggaagctgcacaccagccccctctgcaccaccaacacgaaggaggggtccaacatctgcctgacccgcaccgaccggggctggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggggccatcgtgtcctgctacggcaagaccaagtgcaccgccagcaacaagtgccgggggatcatcaagaccttctccaacggctgcgactacgtgagcaacaagggcgtcgacacggtgagcgtggggaacaccctctactacgtcaacaagcaggagggcaagtccctgtacgtgaagggggagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccggcaagtccaccaccaacatcatgatcaccacgatcatcatcgtgatcatcgtcatcctcctgagcctgatcgccgtggggctcctgctgtactgcaaggcccggtccaccccggtgaccctgagcaaggaccagctctccggcatcaacaacatcgccttcagcaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5673 - RNA, 1997 nt, synthetic construct
  misc_feature 1..1997: note = mRNA product Design i-2 comprising derived and/or modified sequence from HRSV(A2)__F_DSCav1_mut5 (opt2)
  source 1..1997: mol_type = other RNA
gggagaggcgctgcctacggaggtggcagccatctccttctcggcatcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5674 - RNA, 1997 nt, synthetic construct
  misc_feature 1..1997: note = mRNA product Design i-2 comprising derived and/or modified sequence from HRSV(A2)__F_DSCav1_mut5 (opt3)
  source 1..1997: mol_type = other RNA
gggagaggcgctgcctacggaggtggcagccatctccttctcggcatcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcggttgcggggtgtccgtattaacttttaaggttctggaccttaagaactacattgataaacaattgctgcctatcctaaataagcagtcatgtagtattagcaacatcgagaccgtgatagagttccagcagaaaaataacaggctcctggaaattacacgggagttttctgtcaatgcgggagtgactaccccagtgtccacatatatgcttaccaactcagaactgttgagcctcatcaatgacatgccgattacgaacgatcaaaagaaactgatgagtaacaatgtccagatcgttcgccagcagtcttactccatcatgtgcattataaaggaggaagtgttagcatatgtagtgcaactgcccctctacggcgtcatcgacactccttgttggaaacttcatacaagcccactgtgcaccactaacacaaaggagggctcgaatatttgtttgacccgaacggatcgtgggtggtactgcgacaacgccggatctgtgtccttctttccccaggctgaaacctgtaaggttcagtcaaatagagtgttctgcgatacaatgaacagtagaactctgcctagcgaggtcaatctctgcaacgtggacatctttaatccaaaatatgattgtaagataatgacctccaaaacagacgtatctagctcagttattaccagtctgggtgccatcgtgtcctgctacggcaagactaaatgtacagcaagcaacaagtgcagggggatcattaagaccttctctaatggatgtgattatgtctcaaacaaaggcgtggacactgtcagtgtgggtaatacgctttactatgttaacaagcaagaggggaaaagcctgtacgtgaagggagaacccatcattaatttttatgaccctttggtattcccatccgatgagtttgacgcttctatatcgcaggtcaacgagaaaatcaaccagagcctcgccttcattcggaagtccgatgaactgttacacaatgtgaacgcgggcaagtcaacaaccaatatcatgatcactaccattataatcgttattatcgtgattctgctaagtctcatcgccgtcggcctgcttttgtactgcaaagcacgctctacaccggtgaccctgagcaaggaccagctctccgggataaacaatatcgctttctcaaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5675 - RNA, 1997 nt, synthetic construct
  misc_feature 1..1997: note = mRNA product Design i-2 comprising derived and/or modified sequence from HRSV(A2)__F_DSCav1_mut5 (opt4)
  source 1..1997: mol_type = other RNA
gggagaggcgctgcctacggaggtggcagccatctccttctcggcatcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5676 - RNA, 1997 nt, synthetic construct
  misc_feature 1..1997: note = mRNA product Design i-2 comprising derived and/or modified sequence from HRSV(A2)__F_DSCav1_mut5 (opt5)
  source 1..1997: mol_type = other RNA
gggagaggcgctgcctacggaggtggcagccatctccttctcggcatcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcggatgcggcgtttctgtgctgacatttaaggtccttgacctgaagaactacattgataaacaactcctgcctatcctgaataagcagtcctgtagcatttctaacatcgagaccgtgattgagttccagcagaaaaataaccggctcctggaaatcacgcgcgagttttccgtgaatgccggcgtcacaaccccggttagcacatatatgcttaccaactccgaactgctctctctgatcaatgacatgcccattaccaacgatcaaaagaaacttatgagcaacaatgtgcagatcgtgagacagcagtcctacagcattatgtgcatcattaaggaggaagtcctggcttatgtggttcaactccctctgtacggggtgatcgacacaccctgttggaaactgcatacgtctcctctctgcaccacaaacaccaaggagggatccaatatctgtctgacacggaccgatcgcggctggtactgcgacaacgccgggagcgtctctttctttccccaggcggaaacgtgtaaggtgcagagcaatagagttttctgcgatacaatgaactccagaaccctgccttctgaggtgaatctctgcaacgtcgacatttttaatccgaaatatgattgtaagatcatgaccagcaaaacagacgtgtccagctctgtcattacctccctgggagccatcgtgagctgctacggcaagacaaaatgtacggcttctaacaagtgccgggggattatcaagaccttctccaatggatgtgattatgttagcaacaaaggcgtggacacagtctccgtgggcaataccctttactatgttaacaagcaagaggggaaatctctgtacgtgaagggagaacccatcattaatttttatgaccctctcgtcttccccagcgatgagtttgacgcctccatctctcaggtgaacgagaaaattaaccagagcctggctttcatccgcaagtccgatgaactgctccacaatgtgaacgccggcaagagcacaaccaatattatgatcacgaccattatcatcgttattatcgtcattctgctttctctgatcgccgtggggctcctgctgtactgcaaagctagatccacacctgtgacccttagcaaggaccagctctctggaattaacaatatcgcgttctccaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5677 - RNA, 1997 nt, synthetic construct
  misc_feature 1..1997: note = mRNA product Design i-2 comprising derived and/or modified sequence from HRSV(A2)__F_DSCav1_mut5 (opt6)
  source 1..1997: mol_type = other RNA
gggagaggcgctgcctacggaggtggcagccatctccttctcggcatcaagcttaccatggaactattaatacttaaagccaacgcaataacaacaattctcactgctgtcaccttctgcttcgcctcaggccaaaacataacggaagaattttaccaatcaacatgctctgcagtatccaaaggctacctatctgctctaagaacaggttggtatacatcagtaataaccatagaactatcaaacataaaagaaaataaatgcaacggaacagacgcaaaagttaaactcataaaacaagaactagacaaatataaaaacgcagttaccgaactacaactacttatgcaatccactcccgccactggatcaggatcagcaatagcatcaggagtcgcagtatgtaaagtcttacacctcgaaggcgaagtcaataaaatcaaatccgcattactatccacaaacaaagcagtcgtatccctaagcggatgcggagtatcagtactaacatttaaagtactagacctaaaaaattacatcgataaacaactattacctatattaaacaaacaatcctgctccatttcaaatatcgaaaccgtaatagaatttcaacaaaaaaacaacagattactagaaataacaagagaattttccgtaaatgctggcgtaacaacaccagtatccacatacatgctcacaaactccgaactactatcactaataaatgacatgcccataacaaacgatcaaaaaaaactaatgtcaaataatgtacaaatagtaagacaacaaagctactccatcatgtgtataataaaagaagaagtactagcatacgtagttcaactaccactttacggcgtaatcgacaccccttgctggaaactacacacctcccctctatgcaccacaaacacaaaagaaggttccaacatatgccttaccagaacagacagaggctggtattgcgacaacgcaggatcagtttcattttttccacaagctgaaacatgcaaagtacaatcaaacagagtcttctgcgacacaatgaactcaagaactctaccctcagaagtaaacctatgtaacgtagacattttcaaccccaaatacgactgcaaaattatgacatcaaaaacagacgtttcatcatcagttatcacctcattaggagcaatagtaagctgctacggaaaaacaaaatgcaccgcctcaaataaatgcagaggaataataaaaactttctccaacggatgcgactacgtttcaaacaaaggtgtagacactgtatcagtaggaaacacactatattacgtaaataaacaagaaggaaaatcactttatgtcaaaggagaaccaataatcaatttctacgacccattagtattcccatcagacgaatttgatgcttcaatatcacaagtaaacgaaaaaataaatcaatcactcgcatttatacgaaaatcagacgaactactacacaatgtaaacgcaggcaaatcaacaacaaacataatgataacaacaataatcattgtaataatagtaatacttctatctctaatagcagtaggattactcctctactgcaaagcaagatcaacccctgtaacactatcaaaagaccaactttcaggtataaataatatagctttttccaattaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5678 - RNA, 1997 nt, synthetic construct
  misc_feature 1..1997: note = mRNA product Design i-2 comprising derived and/or modified sequence from HRSV(A2)__F_DSCav1_mut5 (opt11)
  source 1..1997: mol_type = other RNA
gggagaggcgctgcctacggaggtggcagccatctccttctcggcatcaagcttaccatggagctcctaatcctcaaagccaacgcgatcactacaatcctcacagccgtcaccttctgcttcgcctccggccaaaacatcaccgaggagttctaccaatcaacctgctccgccgtatcaaaaggatacctaagcgccctacggaccggctggtacacatctgtcatcaccatcgaactatcaaacatcaaagaaaacaaatgcaacggaaccgacgcaaaagtcaaactgattaaacaagaactagacaaatacaaaaacgcagtcaccgaactgcaattactcatgcaaagcacaccggccaccggctcaggcagcgccatcgcctccggcgtcgccgtctgcaaagttctccacctcgagggcgaagtcaacaaaataaaatctgccctcctctccaccaacaaagccgtcgtctccctcagcggctgcggagtctccgtcctcaccttcaaagttctcgatctcaagaactatattgacaaacaacttctacccatactcaacaaacaaagctgcagcatatccaacatcgaaaccgtcatcgagttccaacaaaagaacaaccgcctcctcgaaataacccgcgagttcagcgttaacgccggagtcactacccctgtctccacctacatgctcaccaactccgaactcctatcactaatcaacgacatgcccataaccaacgaccagaagaaactcatgtccaacaacgtccaaattgtccgacaacaaagctactccataatgtgcataataaaagaggaagtcctcgcctacgtcgtacaactgcccctttatggcgtaatcgacacaccctgctggaaactccacacgtcacccctctgcaccaccaacacaaaagaaggctcgaacatctgcctaacacggactgaccgcggctggtactgcgacaacgccggctccgtcagcttcttcccacaagccgaaacctgcaaagtacaatccaaccgagtattctgcgacaccatgaactccagaaccctcccctcagaggtcaacctgtgcaacgtagacatcttcaaccccaaatacgactgcaaaataatgacctcaaaaacagacgtctcctcttccgtaatcaccagcctcggagccatcgtcagctgctacggcaaaaccaaatgcaccgcctcaaacaaatgccgcggcatcatcaaaacattctcaaacggctgcgactacgtctccaacaaaggcgtcgacacagtaagcgtaggcaacacactgtactacgtcaacaaacaagagggaaaatcactctacgtcaaaggagaacccataatcaacttctacgaccccctcgttttccccagcgacgagttcgacgccagcatatcccaagtcaacgagaaaattaaccaatccctagcattcatccgaaaatctgacgaactgctccacaacgtcaacgcgggaaaatcaacaaccaacataatgataaccacaatcataatagtcatcatcgtaatcctcctcagcctaatcgctgtcggcctcctcctctactgcaaagcccgttccaccccagtcacactttccaaggaccaactaagcggaataaacaacatcgcgttctcaaactaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5679 - RNA, 1993 nt, synthetic construct
  misc_feature 1..1993: note = mRNA product Design i-2 comprising derived and/or modified sequence from HRSV(A2)__F_DSCav1_mut5 (opt1)
  source 1..1993: mol_type = other RNA
ggggcgctgcctacggaggtggcagccatctccttctcggcatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5680 - RNA, 1993 nt, synthetic construct
  misc_feature 1..1993: note = mRNA product Design i-2 comprising derived and/or modified sequence from HRSV(A2)__F_DSCav1_mut5 (opt1)
  source 1..1993: mol_type = other RNA
ggggcgctgcctacggaggtggcagccatctccttctcggcatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcgggtgcggcgtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggggtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggcgtgatcgacacgccgtgctggaagctgcacaccagccccctctgcaccaccaacacgaaggaggggtccaacatctgcctgacccgcaccgaccggggctggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggggccatcgtgtcctgctacggcaagaccaagtgcaccgccagcaacaagtgccgggggatcatcaagaccttctccaacggctgcgactacgtgagcaacaagggcgtcgacacggtgagcgtggggaacaccctctactacgtcaacaagcaggagggcaagtccctgtacgtgaagggggagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccggcaagtccaccaccaacatcatgatcaccacgatcatcatcgtgatcatcgtcatcctcctgagcctgatcgccgtggggctcctgctgtactgcaaggcccggtccaccccggtgaccctgagcaaggaccagctctccggcatcaacaacatcgccttcagcaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5681 - RNA, 1993 nt, synthetic construct
  misc_feature 1..1993: note = mRNA product Design i-2 comprising derived and/or modified sequence from HRSV(A2)__F_DSCav1_mut5 (opt2)
  source 1..1993: mol_type = other RNA
ggggcgctgcctacggaggtggcagccatctccttctcggcatcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5682 - RNA, 1993 nt, synthetic construct
  misc_feature 1..1993: note = mRNA product Design i-2 comprising derived and/or modified sequence from HRSV(A2)__F_DSCav1_mut5 (opt3)
  source 1..1993: mol_type = other RNA
ggggcgctgcctacggaggtggcagccatctccttctcggcatcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcggttgcggggtgtccgtattaacttttaaggttctggaccttaagaactacattgataaacaattgctgcctatcctaaataagcagtcatgtagtattagcaacatcgagaccgtgatagagttccagcagaaaaataacaggctcctggaaattacacgggagttttctgtcaatgcgggagtgactaccccagtgtccacatatatgcttaccaactcagaactgttgagcctcatcaatgacatgccgattacgaacgatcaaaagaaactgatgagtaacaatgtccagatcgttcgccagcagtcttactccatcatgtgcattataaaggaggaagtgttagcatatgtagtgcaactgcccctctacggcgtcatcgacactccttgttggaaacttcatacaagcccactgtgcaccactaacacaaaggagggctcgaatatttgtttgacccgaacggatcgtgggtggtactgcgacaacgccggatctgtgtccttctttccccaggctgaaacctgtaaggttcagtcaaatagagtgttctgcgatacaatgaacagtagaactctgcctagcgaggtcaatctctgcaacgtggacatctttaatccaaaatatgattgtaagataatgacctccaaaacagacgtatctagctcagttattaccagtctgggtgccatcgtgtcctgctacggcaagactaaatgtacagcaagcaacaagtgcagggggatcattaagaccttctctaatggatgtgattatgtctcaaacaaaggcgtggacactgtcagtgtgggtaatacgctttactatgttaacaagcaagaggggaaaagcctgtacgtgaagggagaacccatcattaatttttatgaccctttggtattcccatccgatgagtttgacgcttctatatcgcaggtcaacgagaaaatcaaccagagcctcgccttcattcggaagtccgatgaactgttacacaatgtgaacgcgggcaagtcaacaaccaatatcatgatcactaccattataatcgttattatcgtgattctgctaagtctcatcgccgtcggcctgcttttgtactgcaaagcacgctctacaccggtgaccctgagcaaggaccagctctccgggataaacaatatcgctttctcaaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5683 - RNA, 1993 nt, synthetic construct
  misc_feature 1..1993: note = mRNA product Design i-2 comprising derived and/or modified sequence from HRSV(A2)__F_DSCav1_mut5 (opt4)
  source 1..1993: mol_type = other RNA
ggggcgctgcctacggaggtggcagccatctccttctcggcatcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5684 - RNA, 1993 nt, synthetic construct
  misc_feature 1..1993: note = mRNA product Design i-2 comprising derived and/or modified sequence from HRSV(A2)__F_DSCav1_mut5 (opt5)
  source 1..1993: mol_type = other RNA
ggggcgctgcctacggaggtggcagccatctccttctcggcatcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcggatgcggcgtttctgtgctgacatttaaggtccttgacctgaagaactacattgataaacaactcctgcctatcctgaataagcagtcctgtagcatttctaacatcgagaccgtgattgagttccagcagaaaaataaccggctcctggaaatcacgcgcgagttttccgtgaatgccggcgtcacaaccccggttagcacatatatgcttaccaactccgaactgctctctctgatcaatgacatgcccattaccaacgatcaaaagaaacttatgagcaacaatgtgcagatcgtgagacagcagtcctacagcattatgtgcatcattaaggaggaagtcctggcttatgtggttcaactccctctgtacggggtgatcgacacaccctgttggaaactgcatacgtctcctctctgcaccacaaacaccaaggagggatccaatatctgtctgacacggaccgatcgcggctggtactgcgacaacgccgggagcgtctctttctttccccaggcggaaacgtgtaaggtgcagagcaatagagttttctgcgatacaatgaactccagaaccctgccttctgaggtgaatctctgcaacgtcgacatttttaatccgaaatatgattgtaagatcatgaccagcaaaacagacgtgtccagctctgtcattacctccctgggagccatcgtgagctgctacggcaagacaaaatgtacggcttctaacaagtgccgggggattatcaagaccttctccaatggatgtgattatgttagcaacaaaggcgtggacacagtctccgtgggcaataccctttactatgttaacaagcaagaggggaaatctctgtacgtgaagggagaacccatcattaatttttatgaccctctcgtcttccccagcgatgagtttgacgcctccatctctcaggtgaacgagaaaattaaccagagcctggctttcatccgcaagtccgatgaactgctccacaatgtgaacgccggcaagagcacaaccaatattatgatcacgaccattatcatcgttattatcgtcattctgctttctctgatcgccgtggggctcctgctgtactgcaaagctagatccacacctgtgacccttagcaaggaccagctctctggaattaacaatatcgcgttctccaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5685 - RNA, 1993 nt, synthetic construct
  misc_feature 1..1993: note = mRNA product Design i-2 comprising derived and/or modified sequence from HRSV(A2)__F_DSCav1_mut5 (opt6)
  source 1..1993: mol_type = other RNA
ggggcgctgcctacggaggtggcagccatctccttctcggcatcaagcttaccatggaactattaatacttaaagccaacgcaataacaacaattctcactgctgtcaccttctgcttcgcctcaggccaaaacataacggaagaattttaccaatcaacatgctctgcagtatccaaaggctacctatctgctctaagaacaggttggtatacatcagtaataaccatagaactatcaaacataaaagaaaataaatgcaacggaacagacgcaaaagttaaactcataaaacaagaactagacaaatataaaaacgcagttaccgaactacaactacttatgcaatccactcccgccactggatcaggatcagcaatagcatcaggagtcgcagtatgtaaagtcttacacctcgaaggcgaagtcaataaaatcaaatccgcattactatccacaaacaaagcagtcgtatccctaagcggatgcggagtatcagtactaacatttaaagtactagacctaaaaaattacatcgataaacaactattacctatattaaacaaacaatcctgctccatttcaaatatcgaaaccgtaatagaatttcaacaaaaaaacaacagattactagaaataacaagagaattttccgtaaatgctggcgtaacaacaccagtatccacatacatgctcacaaactccgaactactatcactaataaatgacatgcccataacaaacgatcaaaaaaaactaatgtcaaataatgtacaaatagtaagacaacaaagctactccatcatgtgtataataaaagaagaagtactagcatacgtagttcaactaccactttacggcgtaatcgacaccccttgctggaaactacacacctcccctctatgcaccacaaacacaaaagaaggttccaacatatgccttaccagaacagacagaggctggtattgcgacaacgcaggatcagtttcattttttccacaagctgaaacatgcaaagtacaatcaaacagagtcttctgcgacacaatgaactcaagaactctaccctcagaagtaaacctatgtaacgtagacattttcaaccccaaatacgactgcaaaattatgacatcaaaaacagacgtttcatcatcagttatcacctcattaggagcaatagtaagctgctacggaaaaacaaaatgcaccgcctcaaataaatgcagaggaataataaaaactttctccaacggatgcgactacgtttcaaacaaaggtgtagacactgtatcagtaggaaacacactatattacgtaaataaacaagaaggaaaatcactttatgtcaaaggagaaccaataatcaatttctacgacccattagtattcccatcagacgaatttgatgcttcaatatcacaagtaaacgaaaaaataaatcaatcactcgcatttatacgaaaatcagacgaactactacacaatgtaaacgcaggcaaatcaacaacaaacataatgataacaacaataatcattgtaataatagtaatacttctatctctaatagcagtaggattactcctctactgcaaagcaagatcaacccctgtaacactatcaaaagaccaactttcaggtataaataatatagctttttccaattaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5686 - RNA, 1993 nt, synthetic construct
  misc_feature 1..1993: note = mRNA product Design i-2 comprising derived and/or modified sequence from HRSV(A2)__F_DSCav1_mut5 (opt11)
  source 1..1993: mol_type = other RNA
ggggcgctgcctacggaggtggcagccatctccttctcggcatcaagcttaccatggagctcctaatcctcaaagccaacgcgatcactacaatcctcacagccgtcaccttctgcttcgcctccggccaaaacatcaccgaggagttctaccaatcaacctgctccgccgtatcaaaaggatacctaagcgccctacggaccggctggtacacatctgtcatcaccatcgaactatcaaacatcaaagaaaacaaatgcaacggaaccgacgcaaaagtcaaactgattaaacaagaactagacaaatacaaaaacgcagtcaccgaactgcaattactcatgcaaagcacaccggccaccggctcaggcagcgccatcgcctccggcgtcgccgtctgcaaagttctccacctcgagggcgaagtcaacaaaataaaatctgccctcctctccaccaacaaagccgtcgtctccctcagcggctgcggagtctccgtcctcaccttcaaagttctcgatctcaagaactatattgacaaacaacttctacccatactcaacaaacaaagctgcagcatatccaacatcgaaaccgtcatcgagttccaacaaaagaacaaccgcctcctcgaaataacccgcgagttcagcgttaacgccggagtcactacccctgtctccacctacatgctcaccaactccgaactcctatcactaatcaacgacatgcccataaccaacgaccagaagaaactcatgtccaacaacgtccaaattgtccgacaacaaagctactccataatgtgcataataaaagaggaagtcctcgcctacgtcgtacaactgcccctttatggcgtaatcgacacaccctgctggaaactccacacgtcacccctctgcaccaccaacacaaaagaaggctcgaacatctgcctaacacggactgaccgcggctggtactgcgacaacgccggctccgtcagcttcttcccacaagccgaaacctgcaaagtacaatccaaccgagtattctgcgacaccatgaactccagaaccctcccctcagaggtcaacctgtgcaacgtagacatcttcaaccccaaatacgactgcaaaataatgacctcaaaaacagacgtctcctcttccgtaatcaccagcctcggagccatcgtcagctgctacggcaaaaccaaatgcaccgcctcaaacaaatgccgcggcatcatcaaaacattctcaaacggctgcgactacgtctccaacaaaggcgtcgacacagtaagcgtaggcaacacactgtactacgtcaacaaacaagagggaaaatcactctacgtcaaaggagaacccataatcaacttctacgaccccctcgttttccccagcgacgagttcgacgccagcatatcccaagtcaacgagaaaattaaccaatccctagcattcatccgaaaatctgacgaactgctccacaacgtcaacgcgggaaaatcaacaaccaacataatgataaccacaatcataatagtcatcatcgtaatcctcctcagcctaatcgctgtcggcctcctcctctactgcaaagcccgttccaccccagtcacactttccaaggaccaactaagcggaataaacaacatcgcgttctcaaactaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5687 - RNA, 1828 nt, synthetic construct
  misc_feature 1..1828: note = mRNA product Design i-3 comprising derived and/or modified sequence from HRSV(A2)__F_DSCav1_mut5 (opt1) R7456
  source 1..1828: mol_type = other RNA
gggagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5688 - RNA, 1828 nt, synthetic construct
  misc_feature 1..1828: note = mRNA product Design i-3 comprising derived and/or modified sequence from HRSV(A2)__F_DSCav1_mut5 (opt1)
  source 1..1828: mol_type = other RNA
gggagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcgggtgcggcgtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggggtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggcgtgatcgacacgccgtgctggaagctgcacaccagccccctctgcaccaccaacacgaaggaggggtccaacatctgcctgacccgcaccgaccggggctggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggggccatcgtgtcctgctacggcaagaccaagtgcaccgccagcaacaagtgccgggggatcatcaagaccttctccaacggctgcgactacgtgagcaacaagggcgtcgacacggtgagcgtggggaacaccctctactacgtcaacaagcaggagggcaagtccctgtacgtgaagggggagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccggcaagtccaccaccaacatcatgatcaccacgatcatcatcgtgatcatcgtcatcctcctgagcctgatcgccgtggggctcctgctgtactgcaaggcccggtccaccccggtgaccctgagcaaggaccagctctccggcatcaacaacatcgccttcagcaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5689 - RNA, 1828 nt, synthetic construct
  misc_feature 1..1828: note = mRNA product Design i-3 comprising derived and/or modified sequence from HRSV(A2)__F_DSCav1_mut5 (opt2)
  source 1..1828: mol_type = other RNA
gggagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5690 - RNA, 1828 nt, synthetic construct
  misc_feature 1..1828: note = mRNA product Design i-3 comprising derived and/or modified sequence from HRSV(A2)__F_DSCav1_mut5 (opt3)
  source 1..1828: mol_type = other RNA
gggagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcggttgcggggtgtccgtattaacttttaaggttctggaccttaagaactacattgataaacaattgctgcctatcctaaataagcagtcatgtagtattagcaacatcgagaccgtgatagagttccagcagaaaaataacaggctcctggaaattacacgggagttttctgtcaatgcgggagtgactaccccagtgtccacatatatgcttaccaactcagaactgttgagcctcatcaatgacatgccgattacgaacgatcaaaagaaactgatgagtaacaatgtccagatcgttcgccagcagtcttactccatcatgtgcattataaaggaggaagtgttagcatatgtagtgcaactgcccctctacggcgtcatcgacactccttgttggaaacttcatacaagcccactgtgcaccactaacacaaaggagggctcgaatatttgtttgacccgaacggatcgtgggtggtactgcgacaacgccggatctgtgtccttctttccccaggctgaaacctgtaaggttcagtcaaatagagtgttctgcgatacaatgaacagtagaactctgcctagcgaggtcaatctctgcaacgtggacatctttaatccaaaatatgattgtaagataatgacctccaaaacagacgtatctagctcagttattaccagtctgggtgccatcgtgtcctgctacggcaagactaaatgtacagcaagcaacaagtgcagggggatcattaagaccttctctaatggatgtgattatgtctcaaacaaaggcgtggacactgtcagtgtgggtaatacgctttactatgttaacaagcaagaggggaaaagcctgtacgtgaagggagaacccatcattaatttttatgaccctttggtattcccatccgatgagtttgacgcttctatatcgcaggtcaacgagaaaatcaaccagagcctcgccttcattcggaagtccgatgaactgttacacaatgtgaacgcgggcaagtcaacaaccaatatcatgatcactaccattataatcgttattatcgtgattctgctaagtctcatcgccgtcggcctgcttttgtactgcaaagcacgctctacaccggtgaccctgagcaaggaccagctctccgggataaacaatatcgctttctcaaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5691 - RNA, 1828 nt, synthetic construct
  misc_feature 1..1828: note = mRNA product Design i-3 comprising derived and/or modified sequence from HRSV(A2)__F_DSCav1_mut5 (opt4)
  source 1..1828: mol_type = other RNA
gggagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5692 - RNA, 1828 nt, synthetic construct
  misc_feature 1..1828: note = mRNA product Design i-3 comprising derived and/or modified sequence from HRSV(A2)__F_DSCav1_mut5 (opt5)
  source 1..1828: mol_type = other RNA
gggagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcggatgcggcgtttctgtgctgacatttaaggtccttgacctgaagaactacattgataaacaactcctgcctatcctgaataagcagtcctgtagcatttctaacatcgagaccgtgattgagttccagcagaaaaataaccggctcctggaaatcacgcgcgagttttccgtgaatgccggcgtcacaaccccggttagcacatatatgcttaccaactccgaactgctctctctgatcaatgacatgcccattaccaacgatcaaaagaaacttatgagcaacaatgtgcagatcgtgagacagcagtcctacagcattatgtgcatcattaaggaggaagtcctggcttatgtggttcaactccctctgtacggggtgatcgacacaccctgttggaaactgcatacgtctcctctctgcaccacaaacaccaaggagggatccaatatctgtctgacacggaccgatcgcggctggtactgcgacaacgccgggagcgtctctttctttccccaggcggaaacgtgtaaggtgcagagcaatagagttttctgcgatacaatgaactccagaaccctgccttctgaggtgaatctctgcaacgtcgacatttttaatccgaaatatgattgtaagatcatgaccagcaaaacagacgtgtccagctctgtcattacctccctgggagccatcgtgagctgctacggcaagacaaaatgtacggcttctaacaagtgccgggggattatcaagaccttctccaatggatgtgattatgttagcaacaaaggcgtggacacagtctccgtgggcaataccctttactatgttaacaagcaagaggggaaatctctgtacgtgaagggagaacccatcattaatttttatgaccctctcgtcttccccagcgatgagtttgacgcctccatctctcaggtgaacgagaaaattaaccagagcctggctttcatccgcaagtccgatgaactgctccacaatgtgaacgccggcaagagcacaaccaatattatgatcacgaccattatcatcgttattatcgtcattctgctttctctgatcgccgtggggctcctgctgtactgcaaagctagatccacacctgtgacccttagcaaggaccagctctctggaattaacaatatcgcgttctccaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5693 - RNA, 1828 nt, synthetic construct
  misc_feature 1..1828: note = mRNA product Design i-3 comprising derived and/or modified sequence from HRSV(A2)__F_DSCav1_mut5 (opt6)
  source 1..1828: mol_type = other RNA
gggagaaagcttaccatggaactattaatacttaaagccaacgcaataacaacaattctcactgctgtcaccttctgcttcgcctcaggccaaaacataacggaagaattttaccaatcaacatgctctgcagtatccaaaggctacctatctgctctaagaacaggttggtatacatcagtaataaccatagaactatcaaacataaaagaaaataaatgcaacggaacagacgcaaaagttaaactcataaaacaagaactagacaaatataaaaacgcagttaccgaactacaactacttatgcaatccactcccgccactggatcaggatcagcaatagcatcaggagtcgcagtatgtaaagtcttacacctcgaaggcgaagtcaataaaatcaaatccgcattactatccacaaacaaagcagtcgtatccctaagcggatgcggagtatcagtactaacatttaaagtactagacctaaaaaattacatcgataaacaactattacctatattaaacaaacaatcctgctccatttcaaatatcgaaaccgtaatagaatttcaacaaaaaaacaacagattactagaaataacaagagaattttccgtaaatgctggcgtaacaacaccagtatccacatacatgctcacaaactccgaactactatcactaataaatgacatgcccataacaaacgatcaaaaaaaactaatgtcaaataatgtacaaatagtaagacaacaaagctactccatcatgtgtataataaaagaagaagtactagcatacgtagttcaactaccactttacggcgtaatcgacaccccttgctggaaactacacacctcccctctatgcaccacaaacacaaaagaaggttccaacatatgccttaccagaacagacagaggctggtattgcgacaacgcaggatcagtttcattttttccacaagctgaaacatgcaaagtacaatcaaacagagtcttctgcgacacaatgaactcaagaactctaccctcagaagtaaacctatgtaacgtagacattttcaaccccaaatacgactgcaaaattatgacatcaaaaacagacgtttcatcatcagttatcacctcattaggagcaatagtaagctgctacggaaaaacaaaatgcaccgcctcaaataaatgcagaggaataataaaaactttctccaacggatgcgactacgtttcaaacaaaggtgtagacactgtatcagtaggaaacacactatattacgtaaataaacaagaaggaaaatcactttatgtcaaaggagaaccaataatcaatttctacgacccattagtattcccatcagacgaatttgatgcttcaatatcacaagtaaacgaaaaaataaatcaatcactcgcatttatacgaaaatcagacgaactactacacaatgtaaacgcaggcaaatcaacaacaaacataatgataacaacaataatcattgtaataatagtaatacttctatctctaatagcagtaggattactcctctactgcaaagcaagatcaacccctgtaacactatcaaaagaccaactttcaggtataaataatatagctttttccaattaaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5694 - RNA, 1828 nt, synthetic construct
  misc_feature 1..1828: note = mRNA product Design i-3 comprising derived and/or modified sequence from HRSV(A2)__F_DSCav1_mut5 (opt11)
  source 1..1828: mol_type = other RNA
gggagaaagcttaccatggagctcctaatcctcaaagccaacgcgatcactacaatcctcacagccgtcaccttctgcttcgcctccggccaaaacatcaccgaggagttctaccaatcaacctgctccgccgtatcaaaaggatacctaagcgccctacggaccggctggtacacatctgtcatcaccatcgaactatcaaacatcaaagaaaacaaatgcaacggaaccgacgcaaaagtcaaactgattaaacaagaactagacaaatacaaaaacgcagtcaccgaactgcaattactcatgcaaagcacaccggccaccggctcaggcagcgccatcgcctccggcgtcgccgtctgcaaagttctccacctcgagggcgaagtcaacaaaataaaatctgccctcctctccaccaacaaagccgtcgtctccctcagcggctgcggagtctccgtcctcaccttcaaagttctcgatctcaagaactatattgacaaacaacttctacccatactcaacaaacaaagctgcagcatatccaacatcgaaaccgtcatcgagttccaacaaaagaacaaccgcctcctcgaaataacccgcgagttcagcgttaacgccggagtcactacccctgtctccacctacatgctcaccaactccgaactcctatcactaatcaacgacatgcccataaccaacgaccagaagaaactcatgtccaacaacgtccaaattgtccgacaacaaagctactccataatgtgcataataaaagaggaagtcctcgcctacgtcgtacaactgcccctttatggcgtaatcgacacaccctgctggaaactccacacgtcacccctctgcaccaccaacacaaaagaaggctcgaacatctgcctaacacggactgaccgcggctggtactgcgacaacgccggctccgtcagcttcttcccacaagccgaaacctgcaaagtacaatccaaccgagtattctgcgacaccatgaactccagaaccctcccctcagaggtcaacctgtgcaacgtagacatcttcaaccccaaatacgactgcaaaataatgacctcaaaaacagacgtctcctcttccgtaatcaccagcctcggagccatcgtcagctgctacggcaaaaccaaatgcaccgcctcaaacaaatgccgcggcatcatcaaaacattctcaaacggctgcgactacgtctccaacaaaggcgtcgacacagtaagcgtaggcaacacactgtactacgtcaacaaacaagagggaaaatcactctacgtcaaaggagaacccataatcaacttctacgaccccctcgttttccccagcgacgagttcgacgccagcatatcccaagtcaacgagaaaattaaccaatccctagcattcatccgaaaatctgacgaactgctccacaacgtcaacgcgggaaaatcaacaaccaacataatgataaccacaatcataatagtcatcatcgtaatcctcctcagcctaatcgctgtcggcctcctcctctactgcaaagcccgttccaccccagtcacactttccaaggaccaactaagcggaataaacaacatcgcgttctcaaactaaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5695 - protein, 515 aa, synthetic construct
  REGION 1..515: note = derived and/or modified protein sequence (artificial) from HRSV(A2)__F-del_DSCav1_mut5
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATGSGSAIASGVAVCKVLHLEGEVNKIKSALLSTNKAVVSLSGCGVSVLTFKVLDLKNYIDKQLLPILNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSRTLPSEVNLCNVDIFNPKYDCKIMTSKTDVSSSVITSLGAIVSCYGKTKCTASNKCRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKAR

SEQ ID NO: 5696 - RNA, 1548 nt, synthetic construct
  misc_feature 1..1548: note = derived and/or modified CDS sequence (opt1) from HRSV(A2)__F-del_DSCav1_mut5
  source 1..1548: mol_type = other RNA
atggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtga

SEQ ID NO: 5697 - RNA, 1548 nt, synthetic construct
  misc_feature 1..1548: note = derived and/or modified CDS sequence (opt1) from HRSV(A2)__F-del_DSCav1_mut5
  source 1..1548: mol_type = other RNA
atggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcgggtgcggcgtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggggtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggcgtgatcgacacgccgtgctggaagctgcacaccagccccctctgcaccaccaacacgaaggaggggtccaacatctgcctgacccgcaccgaccggggctggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggggccatcgtgtcctgctacggcaagaccaagtgcaccgccagcaacaagtgccgggggatcatcaagaccttctccaacggctgcgactacgtgagcaacaagggcgtcgacacggtgagcgtggggaacaccctctactacgtcaacaagcaggagggcaagtccctgtacgtgaagggggagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccggcaagtccaccaccaacatcatgatcaccacgatcatcatcgtgatcatcgtcatcctcctgagcctgatcgccgtggggctcctgctgtactgcaaggcccggtga

SEQ ID NO: 5698 - RNA, 1548 nt, synthetic construct
  misc_feature 1..1548: note = derived and/or modified CDS sequence (opt2) from HRSV(A2)__F-del_DSCav1_mut5
  source 1..1548: mol_type = other RNA
atggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctga

SEQ ID NO: 5699 - RNA, 1548 nt, synthetic construct
  misc_feature 1..1548: note = derived and/or modified CDS sequence (opt3) from HRSV(A2)__F-del_DSCav1_mut5
  source 1..1548: mol_type = other RNA
atggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcggttgcggggtgtccgtattaacttttaaggttctggaccttaagaactacattgataaacaattgctgcctatcctaaataagcagtcatgtagtattagcaacatcgagaccgtgatagagttccagcagaaaaataacaggctcctggaaattacacgggagttttctgtcaatgcgggagtgactaccccagtgtccacatatatgcttaccaactcagaactgttgagcctcatcaatgacatgccgattacgaacgatcaaaagaaactgatgagtaacaatgtccagatcgttcgccagcagtcttactccatcatgtgcattataaaggaggaagtgttagcatatgtagtgcaactgcccctctacggcgtcatcgacactccttgttggaaacttcatacaagcccactgtgcaccactaacacaaaggagggctcgaatatttgtttgacccgaacggatcgtgggtggtactgcgacaacgccggatctgtgtccttctttccccaggctgaaacctgtaaggttcagtcaaatagagtgttctgcgatacaatgaacagtagaactctgcctagcgaggtcaatctctgcaacgtggacatctttaatccaaaatatgattgtaagataatgacctccaaaacagacgtatctagctcagttattaccagtctgggtgccatcgtgtcctgctacggcaagactaaatgtacagcaagcaacaagtgcagggggatcattaagaccttctctaatggatgtgattatgtctcaaacaaaggcgtggacactgtcagtgtgggtaatacgctttactatgttaacaagcaagaggggaaaagcctgtacgtgaagggagaacccatcattaatttttatgaccctttggtattcccatccgatgagtttgacgcttctatatcgcaggtcaacgagaaaatcaaccagagcctcgccttcattcggaagtccgatgaactgttacacaatgtgaacgcgggcaagtcaacaaccaatatcatgatcactaccattataatcgttattatcgtgattctgctaagtctcatcgccgtcggcctgcttttgtactgcaaagcacgctga

SEQ ID NO: 5700 - RNA, 1548 nt, synthetic construct
  misc_feature 1..1548: note = derived and/or modified CDS sequence (opt4) from HRSV(A2)__F-del_DSCav1_mut5
  source 1..1548: mol_type = other RNA
atggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatga

SEQ ID NO: 5701 - RNA, 1548 nt, synthetic construct
  misc_feature 1..1548: note = derived and/or modified CDS sequence (opt5) from HRSV(A2)__F-del_DSCav1_mut5
  source 1..1548: mol_type = other RNA
atggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcggatgcggcgtttctgtgctgacatttaaggtccttgacctgaagaactacattgataaacaactcctgcctatcctgaataagcagtcctgtagcatttctaacatcgagaccgtgattgagttccagcagaaaaataaccggctcctggaaatcacgcgcgagttttccgtgaatgccggcgtcacaaccccggttagcacatatatgcttaccaactccgaactgctctctctgatcaatgacatgcccattaccaacgatcaaaagaaacttatgagcaacaatgtgcagatcgtgagacagcagtcctacagcattatgtgcatcattaaggaggaagtcctggcttatgtggttcaactccctctgtacggggtgatcgacacaccctgttggaaactgcatacgtctcctctctgcaccacaaacaccaaggagggatccaatatctgtctgacacggaccgatcgcggctggtactgcgacaacgccgggagcgtctctttctttccccaggcggaaacgtgtaaggtgcagagcaatagagttttctgcgatacaatgaactccagaaccctgccttctgaggtgaatctctgcaacgtcgacatttttaatccgaaatatgattgtaagatcatgaccagcaaaacagacgtgtccagctctgtcattacctccctgggagccatcgtgagctgctacggcaagacaaaatgtacggcttctaacaagtgccgggggattatcaagaccttctccaatggatgtgattatgttagcaacaaaggcgtggacacagtctccgtgggcaataccctttactatgttaacaagcaagaggggaaatctctgtacgtgaagggagaacccatcattaatttttatgaccctctcgtcttccccagcgatgagtttgacgcctccatctctcaggtgaacgagaaaattaaccagagcctggctttcatccgcaagtccgatgaactgctccacaatgtgaacgccggcaagagcacaaccaatattatgatcacgaccattatcatcgttattatcgtcattctgctttctctgatcgccgtggggctcctgctgtactgcaaagctagatga

SEQ ID NO: 5702 - RNA, 1548 nt, synthetic construct
  misc_feature 1..1548: note = derived and/or modified CDS sequence (opt6) from HRSV(A2)__F-del_DSCav1_mut5
  source 1..1548: mol_type = other RNA
atggaacttttaatactgaaagcaaatgccatcacaaccatactaactgccgtcacattctgctttgcatcaggacaaaacataacagaagaattttaccaatccacatgctcagcagtatcaaaaggatatctatcggcacttagaactggatggtacacaagtgttataactatagaactctcaaacataaaagaaaacaaatgcaatggaacagacgcaaaagtaaaactaataaaacaagaactcgataaatataaaaatgcagtaaccgaactacaactattaatgcaaagcacacccgcaacaggcagcggatcagcaatagcaagcggagtcgcagtatgtaaagtactacatctagaaggagaagtcaacaaaatcaaatctgcacttctatccacaaacaaagctgtagtatccctatccggatgcggagtctcagtattaacttttaaagtactagaccttaaaaactacatagataaacaactattaccaatactaaataaacaatcatgcagcatatccaatatagagacagtaattgaatttcaacaaaaaaacaacagattactagaaattactcgtgaattttccgtaaatgccggagtcacaacaccagtatcaacctatatgctaacaaacagcgaactacttagcttaataaatgacatgccaataacaaatgaccaaaaaaaacttatgtcaaataacgtacaaatcgtcagacaacaatcctactctataatgtgtataattaaagaagaagtcctagcatacgtagttcaattaccactctatggagtaatagatacaccatgctggaaactacacacgtcaccactatgtacaacaaacacaaaagaaggatccaatatatgcctaacaagaaccgacagaggctggtattgtgacaacgcaggatccgtttcattcttcccacaagcagaaacctgtaaagtacaatctaatagagtattttgcgacacaatgaacagtagaacactaccaagcgaggttaatctatgtaacgtagacatattcaatccaaaatatgattgcaaaataatgacatcaaaaacagatgtatcgtcgagtgtaataacaagtctgggagctatagtaagctgctacggcaagacgaaatgtaccgcttcaaataaatgcagaggaatcattaaaacattctcgaacggatgcgactacgtaagtaataaaggtgtcgacaccgtatcagtagggaatacattatactacgtcaacaaacaagaaggaaaatctctatatgtaaaaggagaaccaataataaatttctatgaccctctagtattcccatcagatgaatttgacgcttccatatcacaagtaaacgaaaaaatcaatcaatctttagcattcatacgaaaaagtgatgaactcctacacaacgtcaacgcaggaaaaagcacaacaaatataatgatcacaacaatcatcatagtaataatagtaatactactatcattaatagcagtaggattattgctttactgcaaagcacgatag

SEQ ID NO: 5703 - RNA, 1548 nt, synthetic construct
  misc_feature 1..1548: note = derived and/or modified CDS sequence (opt11) from HRSV(A2)__F-del_DSCav1_mut5
  source 1..1548: mol_type = other RNA
atggaactcctcatcctcaaagccaacgccataaccacaatactcaccgccgtaaccttctgctttgcgtcgggacaaaacatcaccgaagagttctaccaatccacttgctccgcagtaagcaaaggatacctctccgccctgcgaaccggttggtacacatcagtcatcacaatcgaactctcaaacataaaagaaaacaaatgcaacggcaccgacgcaaaggtcaaattaatcaagcaagaactagacaaatacaaaaacgccgtcacagaactccagctgctaatgcagagcacacccgcaactggcagcggatccgccatcgcatcaggagtcgccgtgtgcaaagtcctacacctcgaaggagaagtgaacaaaatcaaatcagccctactctccaccaacaaggccgtcgtctccctctccggctgcggtgtctccgtcctaaccttcaaagtgctagacctcaagaactacatcgacaaacaactcctaccaatactcaacaagcaatcttgctccatctccaacatcgaaaccgtaatcgagttccaacagaagaacaaccgcctcctcgaaatcacccgcgagttctctgtcaacgcaggggtcaccactcccgtctccacatacatgctcacaaactccgaactcctcagcctcatcaacgacatgcccataaccaacgaccagaaaaagctaatgagcaataacgtccaaatcgttagacaacaaagttattccatcatgtgcatcatcaaagaagaagtcctcgcctacgtcgtacaactccccctctatggcgtcatcgacaccccctgctggaaactgcacacatcacccctctgcaccacaaacaccaaagaaggctcaaacatctgcctaactcgcaccgaccgcggctggtactgcgacaacgccggcagcgtatcattctttccccaagccgaaacatgcaaagttcaatccaaccgcgtcttctgcgacacaatgaactccagaacgctccccagcgaagtcaacctctgtaacgtagacatcttcaaccctaagtacgactgcaaaatcatgacctccaaaactgatgtatcctcctccgtcatcacatccctgggcgccatcgtcagctgctacggcaaaacaaaatgcactgcctcaaacaaatgccgaggtatcataaagaccttctcaaacggatgcgattacgtcagcaacaaaggcgtcgacaccgtcagtgtcggcaacaccctctactacgtcaacaaacaagaaggaaaatccctctacgtcaaaggcgaacccatcatcaacttctacgaccccctcgtcttccccagcgacgagttcgacgcctccatctcacaagtcaacgaaaagataaaccaatctctagccttcatccgcaaatccgatgaactcctgcataacgtcaacgccggcaaatccaccacaaacatcatgatcactaccataatcatcgtcataatcgtaatcctcctatctcttatcgcagtcggcctactactctactgcaaagcccgctaa

SEQ ID NO: 5704 - RNA, 1824 nt, synthetic construct
  misc_feature 1..1824: note = mRNA product Design a-1 comprising derived and/or modified sequence from HRSV(A2)__F-del_DSCav1_mut5 (opt1)
  source 1..1824: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5705 - RNA, 1824 nt, synthetic construct
  misc_feature 1..1824: note = mRNA product Design a-1 comprising derived and/or modified sequence from HRSV(A2)__F-del_DSCav1_mut5 (opt1)
  source 1..1824: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcgggtgcggcgtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggggtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggcgtgatcgacacgccgtgctggaagctgcacaccagccccctctgcaccaccaacacgaaggaggggtccaacatctgcctgacccgcaccgaccggggctggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggggccatcgtgtcctgctacggcaagaccaagtgcaccgccagcaacaagtgccgggggatcatcaagaccttctccaacggctgcgactacgtgagcaacaagggcgtcgacacggtgagcgtggggaacaccctctactacgtcaacaagcaggagggcaagtccctgtacgtgaagggggagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccggcaagtccaccaccaacatcatgatcaccacgatcatcatcgtgatcatcgtcatcctcctgagcctgatcgccgtggggctcctgctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5706 - RNA, 1824 nt, synthetic construct
  misc_feature 1..1824: note = mRNA product Design a-1 comprising derived and/or modified sequence from HRSV(A2)__F-del_DSCav1_mut5 (opt2)
  source 1..1824: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5707 - RNA, 1824 nt, synthetic construct
  misc_feature 1..1824: note = mRNA product Design a-1 comprising derived and/or modified sequence from HRSV(A2)__F-del_DSCav1_mut5 (opt3)
  source 1..1824: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcggttgcggggtgtccgtattaacttttaaggttctggaccttaagaactacattgataaacaattgctgcctatcctaaataagcagtcatgtagtattagcaacatcgagaccgtgatagagttccagcagaaaaataacaggctcctggaaattacacgggagttttctgtcaatgcgggagtgactaccccagtgtccacatatatgcttaccaactcagaactgttgagcctcatcaatgacatgccgattacgaacgatcaaaagaaactgatgagtaacaatgtccagatcgttcgccagcagtcttactccatcatgtgcattataaaggaggaagtgttagcatatgtagtgcaactgcccctctacggcgtcatcgacactccttgttggaaacttcatacaagcccactgtgcaccactaacacaaaggagggctcgaatatttgtttgacccgaacggatcgtgggtggtactgcgacaacgccggatctgtgtccttctttccccaggctgaaacctgtaaggttcagtcaaatagagtgttctgcgatacaatgaacagtagaactctgcctagcgaggtcaatctctgcaacgtggacatctttaatccaaaatatgattgtaagataatgacctccaaaacagacgtatctagctcagttattaccagtctgggtgccatcgtgtcctgctacggcaagactaaatgtacagcaagcaacaagtgcagggggatcattaagaccttctctaatggatgtgattatgtctcaaacaaaggcgtggacactgtcagtgtgggtaatacgctttactatgttaacaagcaagaggggaaaagcctgtacgtgaagggagaacccatcattaatttttatgaccctttggtattcccatccgatgagtttgacgcttctatatcgcaggtcaacgagaaaatcaaccagagcctcgccttcattcggaagtccgatgaactgttacacaatgtgaacgcgggcaagtcaacaaccaatatcatgatcactaccattataatcgttattatcgtgattctgctaagtctcatcgccgtcggcctgcttttgtactgcaaagcacgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5708 - RNA, 1824 nt, synthetic construct
  misc_feature 1..1824: note = mRNA product Design a-1 comprising derived and/or modified sequence from HRSV(A2)__F-del_DSCav1_mut5 (opt4)
  source 1..1824: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5709 - RNA, 1824 nt, synthetic construct
  misc_feature 1..1824: note = mRNA product Design a-1 comprising derived and/or modified sequence from HRSV(A2)__F-del_DSCav1_mut5 (opt5)
  source 1..1824: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcggatgcggcgtttctgtgctgacatttaaggtccttgacctgaagaactacattgataaacaactcctgcctatcctgaataagcagtcctgtagcatttctaacatcgagaccgtgattgagttccagcagaaaaataaccggctcctggaaatcacgcgcgagttttccgtgaatgccggcgtcacaaccccggttagcacatatatgcttaccaactccgaactgctctctctgatcaatgacatgcccattaccaacgatcaaaagaaacttatgagcaacaatgtgcagatcgtgagacagcagtcctacagcattatgtgcatcattaaggaggaagtcctggcttatgtggttcaactccctctgtacggggtgatcgacacaccctgttggaaactgcatacgtctcctctctgcaccacaaacaccaaggagggatccaatatctgtctgacacggaccgatcgcggctggtactgcgacaacgccgggagcgtctctttctttccccaggcggaaacgtgtaaggtgcagagcaatagagttttctgcgatacaatgaactccagaaccctgccttctgaggtgaatctctgcaacgtcgacatttttaatccgaaatatgattgtaagatcatgaccagcaaaacagacgtgtccagctctgtcattacctccctgggagccatcgtgagctgctacggcaagacaaaatgtacggcttctaacaagtgccgggggattatcaagaccttctccaatggatgtgattatgttagcaacaaaggcgtggacacagtctccgtgggcaataccctttactatgttaacaagcaagaggggaaatctctgtacgtgaagggagaacccatcattaatttttatgaccctctcgtcttccccagcgatgagtttgacgcctccatctctcaggtgaacgagaaaattaaccagagcctggctttcatccgcaagtccgatgaactgctccacaatgtgaacgccggcaagagcacaaccaatattatgatcacgaccattatcatcgttattatcgtcattctgctttctctgatcgccgtggggctcctgctgtactgcaaagctagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5710 - RNA, 1824 nt, synthetic construct
  misc_feature 1..1824: note = mRNA product Design a-1 comprising derived and/or modified sequence from HRSV(A2)__F-del_DSCav1_mut5 (opt6)
  source 1..1824: mol_type = other RNA
gggagagtcccgcagtcggcgtccagcggctctgcttgttcgtgtgtgtgtcgttgcaggccttattcaagcttaccatggaacttttaatactgaaagcaaatgccatcacaaccatactaactgccgtcacattctgctttgcatcaggacaaaacataacagaagaattttaccaatccacatgctcagcagtatcaaaaggatatctatcggcacttagaactggatggtacacaagtgttataactatagaactctcaaacataaaagaaaacaaatgcaatggaacagacgcaaaagtaaaactaataaaacaagaactcgataaatataaaaatgcagtaaccgaactacaactattaatgcaaagcacacccgcaacaggcagcggatcagcaatagcaagcggagtcgcagtatgtaaagtactacatctagaaggagaagtcaacaaaatcaaatctgcacttctatccacaaacaaagctgtagtatccctatccggatgcggagtctcagtattaacttttaaagtactagaccttaaaaactacatagataaacaactattaccaatactaaataaacaatcatgcagcatatccaatatagagacagtaattgaatttcaacaaaaaaacaacagattactagaaattactcgtgaattttccgtaaatgccggagtcacaacaccagtatcaacctatatgctaacaaacagcgaactacttagcttaataaatgacatgccaataacaaatgaccaaaaaaaacttatgtcaaataacgtacaaatcgtcagacaacaatcctactctataatgtgtataattaaagaagaagtcctagcatacgtagttcaattaccactctatggagtaatagatacaccatgctggaaactacacacgtcaccactatgtacaacaaacacaaaagaaggatccaatatatgcctaacaagaaccgacagaggctggtattgtgacaacgcaggatccgtttcattcttcccacaagcagaaacctgtaaagtacaatctaatagagtattttgcgacacaatgaacagtagaacactaccaagcgaggttaatctatgtaacgtagacatattcaatccaaaatatgattgcaaaataatgacatcaaaaacagatgtatcgtcgagtgtaataacaagtctgggagctatagtaagctgctacggcaagacgaaatgtaccgcttcaaataaatgcagaggaatcattaaaacattctcgaacggatgcgactacgtaagtaataaaggtgtcgacaccgtatcagtagggaatacattatactacgtcaacaaacaagaaggaaaatctctatatgtaaaaggagaaccaataataaatttctatgaccctctagtattcccatcagatgaatttgacgcttccatatcacaagtaaacgaaaaaatcaatcaatctttagcattcatacgaaaaagtgatgaactcctacacaacgtcaacgcaggaaaaagcacaacaaatataatgatcacaacaatcatcatagtaataatagtaatactactatcattaatagcagtaggattattgctttactgcaaagcacgatagggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5711 - RNA, 1824 nt, synthetic construct
  misc_feature 1..1824: note = mRNA product Design a-1 comprising derived and/or modified sequence from HRSV(A2)__F-del_DSCav1_mut5 (opt11)
  source 1..1824: mol_type = other RNA
gggagagtcccgcagtcggcgtccagcggctctgcttgttcgtgtgtgtgtcgttgcaggccttattcaagcttaccatggaactcctcatcctcaaagccaacgccataaccacaatactcaccgccgtaaccttctgctttgcgtcgggacaaaacatcaccgaagagttctaccaatccacttgctccgcagtaagcaaaggatacctctccgccctgcgaaccggttggtacacatcagtcatcacaatcgaactctcaaacataaaagaaaacaaatgcaacggcaccgacgcaaaggtcaaattaatcaagcaagaactagacaaatacaaaaacgccgtcacagaactccagctgctaatgcagagcacacccgcaactggcagcggatccgccatcgcatcaggagtcgccgtgtgcaaagtcctacacctcgaaggagaagtgaacaaaatcaaatcagccctactctccaccaacaaggccgtcgtctccctctccggctgcggtgtctccgtcctaaccttcaaagtgctagacctcaagaactacatcgacaaacaactcctaccaatactcaacaagcaatcttgctccatctccaacatcgaaaccgtaatcgagttccaacagaagaacaaccgcctcctcgaaatcacccgcgagttctctgtcaacgcaggggtcaccactcccgtctccacatacatgctcacaaactccgaactcctcagcctcatcaacgacatgcccataaccaacgaccagaaaaagctaatgagcaataacgtccaaatcgttagacaacaaagttattccatcatgtgcatcatcaaagaagaagtcctcgcctacgtcgtacaactccccctctatggcgtcatcgacaccccctgctggaaactgcacacatcacccctctgcaccacaaacaccaaagaaggctcaaacatctgcctaactcgcaccgaccgcggctggtactgcgacaacgccggcagcgtatcattctttccccaagccgaaacatgcaaagttcaatccaaccgcgtcttctgcgacacaatgaactccagaacgctccccagcgaagtcaacctctgtaacgtagacatcttcaaccctaagtacgactgcaaaatcatgacctccaaaactgatgtatcctcctccgtcatcacatccctgggcgccatcgtcagctgctacggcaaaacaaaatgcactgcctcaaacaaatgccgaggtatcataaagaccttctcaaacggatgcgattacgtcagcaacaaaggcgtcgacaccgtcagtgtcggcaacaccctctactacgtcaacaaacaagaaggaaaatccctctacgtcaaaggcgaacccatcatcaacttctacgaccccctcgtcttccccagcgacgagttcgacgcctccatctcacaagtcaacgaaaagataaaccaatctctagccttcatccgcaaatccgatgaactcctgcataacgtcaacgccggcaaatccaccacaaacatcatgatcactaccataatcatcgtcataatcgtaatcctcctatctcttatcgcagtcggcctactactctactgcaaagcccgctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5712 - RNA, 1843 nt, synthetic construct
  misc_feature 1..1843: note = mRNA product Design a-2 comprising derived and/or modified sequence from HRSV(A2)__F-del_DSCav1_mut5 (opt1)
  source 1..1843: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5713 - RNA, 1843 nt, synthetic construct
  misc_feature 1..1843: note = mRNA product Design a-2 comprising derived and/or modified sequence from HRSV(A2)__F-del_DSCav1_mut5 (opt1)
  source 1..1843: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcgggtgcggcgtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggggtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggcgtgatcgacacgccgtgctggaagctgcacaccagccccctctgcaccaccaacacgaaggaggggtccaacatctgcctgacccgcaccgaccggggctggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggggccatcgtgtcctgctacggcaagaccaagtgcaccgccagcaacaagtgccgggggatcatcaagaccttctccaacggctgcgactacgtgagcaacaagggcgtcgacacggtgagcgtggggaacaccctctactacgtcaacaagcaggagggcaagtccctgtacgtgaagggggagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccggcaagtccaccaccaacatcatgatcaccacgatcatcatcgtgatcatcgtcatcctcctgagcctgatcgccgtggggctcctgctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5714 - RNA, 1843 nt, synthetic construct
  misc_feature 1..1843: note = mRNA product Design a-2 comprising derived and/or modified sequence from HRSV(A2)__F-del_DSCav1_mut5 (opt2)
  source 1..1843: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5715 - RNA, 1843 nt, synthetic construct
  misc_feature 1..1843: note = mRNA product Design a-2 comprising derived and/or modified sequence from HRSV(A2)__F-del_DSCav1_mut5 (opt3)
  source 1..1843: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcggttgcggggtgtccgtattaacttttaaggttctggaccttaagaactacattgataaacaattgctgcctatcctaaataagcagtcatgtagtattagcaacatcgagaccgtgatagagttccagcagaaaaataacaggctcctggaaattacacgggagttttctgtcaatgcgggagtgactaccccagtgtccacatatatgcttaccaactcagaactgttgagcctcatcaatgacatgccgattacgaacgatcaaaagaaactgatgagtaacaatgtccagatcgttcgccagcagtcttactccatcatgtgcattataaaggaggaagtgttagcatatgtagtgcaactgcccctctacggcgtcatcgacactccttgttggaaacttcatacaagcccactgtgcaccactaacacaaaggagggctcgaatatttgtttgacccgaacggatcgtgggtggtactgcgacaacgccggatctgtgtccttctttccccaggctgaaacctgtaaggttcagtcaaatagagtgttctgcgatacaatgaacagtagaactctgcctagcgaggtcaatctctgcaacgtggacatctttaatccaaaatatgattgtaagataatgacctccaaaacagacgtatctagctcagttattaccagtctgggtgccatcgtgtcctgctacggcaagactaaatgtacagcaagcaacaagtgcagggggatcattaagaccttctctaatggatgtgattatgtctcaaacaaaggcgtggacactgtcagtgtgggtaatacgctttactatgttaacaagcaagaggggaaaagcctgtacgtgaagggagaacccatcattaatttttatgaccctttggtattcccatccgatgagtttgacgcttctatatcgcaggtcaacgagaaaatcaaccagagcctcgccttcattcggaagtccgatgaactgttacacaatgtgaacgcgggcaagtcaacaaccaatatcatgatcactaccattataatcgttattatcgtgattctgctaagtctcatcgccgtcggcctgcttttgtactgcaaagcacgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5716 - RNA, 1843 nt, synthetic construct
  misc_feature 1..1843: note = mRNA product Design a-2 comprising derived and/or modified sequence from HRSV(A2)__F-del_DSCav1_mut5 (opt4)
  source 1..1843: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5717 - RNA, 1843 nt, synthetic construct
  misc_feature 1..1843: note = mRNA product Design a-2 comprising derived and/or modified sequence from HRSV(A2)__F-del_DSCav1_mut5 (opt5)
  source 1..1843: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcggatgcggcgtttctgtgctgacatttaaggtccttgacctgaagaactacattgataaacaactcctgcctatcctgaataagcagtcctgtagcatttctaacatcgagaccgtgattgagttccagcagaaaaataaccggctcctggaaatcacgcgcgagttttccgtgaatgccggcgtcacaaccccggttagcacatatatgcttaccaactccgaactgctctctctgatcaatgacatgcccattaccaacgatcaaaagaaacttatgagcaacaatgtgcagatcgtgagacagcagtcctacagcattatgtgcatcattaaggaggaagtcctggcttatgtggttcaactccctctgtacggggtgatcgacacaccctgttggaaactgcatacgtctcctctctgcaccacaaacaccaaggagggatccaatatctgtctgacacggaccgatcgcggctggtactgcgacaacgccgggagcgtctctttctttccccaggcggaaacgtgtaaggtgcagagcaatagagttttctgcgatacaatgaactccagaaccctgccttctgaggtgaatctctgcaacgtcgacatttttaatccgaaatatgattgtaagatcatgaccagcaaaacagacgtgtccagctctgtcattacctccctgggagccatcgtgagctgctacggcaagacaaaatgtacggcttctaacaagtgccgggggattatcaagaccttctccaatggatgtgattatgttagcaacaaaggcgtggacacagtctccgtgggcaataccctttactatgttaacaagcaagaggggaaatctctgtacgtgaagggagaacccatcattaatttttatgaccctctcgtcttccccagcgatgagtttgacgcctccatctctcaggtgaacgagaaaattaaccagagcctggctttcatccgcaagtccgatgaactgctccacaatgtgaacgccggcaagagcacaaccaatattatgatcacgaccattatcatcgttattatcgtcattctgctttctctgatcgccgtggggctcctgctgtactgcaaagctagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5718 - RNA, 1843 nt, synthetic construct
  misc_feature 1..1843: note = mRNA product Design a-2 comprising derived and/or modified sequence from HRSV(A2)__F-del_DSCav1_mut5 (opt6)
  source 1..1843: mol_type = other RNA
gggagagtccgctcagccaggttgcagaagcggcttagcgtgtgtcctaatcttctctctgcgtgtaggtaggcctgtgccgcaaacaagcttaccatggaacttttaatactgaaagcaaatgccatcacaaccatactaactgccgtcacattctgctttgcatcaggacaaaacataacagaagaattttaccaatccacatgctcagcagtatcaaaaggatatctatcggcacttagaactggatggtacacaagtgttataactatagaactctcaaacataaaagaaaacaaatgcaatggaacagacgcaaaagtaaaactaataaaacaagaactcgataaatataaaaatgcagtaaccgaactacaactattaatgcaaagcacacccgcaacaggcagcggatcagcaatagcaagcggagtcgcagtatgtaaagtactacatctagaaggagaagtcaacaaaatcaaatctgcacttctatccacaaacaaagctgtagtatccctatccggatgcggagtctcagtattaacttttaaagtactagaccttaaaaactacatagataaacaactattaccaatactaaataaacaatcatgcagcatatccaatatagagacagtaattgaatttcaacaaaaaaacaacagattactagaaattactcgtgaattttccgtaaatgccggagtcacaacaccagtatcaacctatatgctaacaaacagcgaactacttagcttaataaatgacatgccaataacaaatgaccaaaaaaaacttatgtcaaataacgtacaaatcgtcagacaacaatcctactctataatgtgtataattaaagaagaagtcctagcatacgtagttcaattaccactctatggagtaatagatacaccatgctggaaactacacacgtcaccactatgtacaacaaacacaaaagaaggatccaatatatgcctaacaagaaccgacagaggctggtattgtgacaacgcaggatccgtttcattcttcccacaagcagaaacctgtaaagtacaatctaatagagtattttgcgacacaatgaacagtagaacactaccaagcgaggttaatctatgtaacgtagacatattcaatccaaaatatgattgcaaaataatgacatcaaaaacagatgtatcgtcgagtgtaataacaagtctgggagctatagtaagctgctacggcaagacgaaatgtaccgcttcaaataaatgcagaggaatcattaaaacattctcgaacggatgcgactacgtaagtaataaaggtgtcgacaccgtatcagtagggaatacattatactacgtcaacaaacaagaaggaaaatctctatatgtaaaaggagaaccaataataaatttctatgaccctctagtattcccatcagatgaatttgacgcttccatatcacaagtaaacgaaaaaatcaatcaatctttagcattcatacgaaaaagtgatgaactcctacacaacgtcaacgcaggaaaaagcacaacaaatataatgatcacaacaatcatcatagtaataatagtaatactactatcattaatagcagtaggattattgctttactgcaaagcacgatagggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5719 - RNA, 1843 nt, synthetic construct
  misc_feature 1..1843: note = mRNA product Design a-2 comprising derived and/or modified sequence from HRSV(A2)__F-del_DSCav1_mut5 (opt11)
  source 1..1843: mol_type = other RNA
gggagagtccgctcagccaggttgcagaagcggcttagcgtgtgtcctaatcttctctctgcgtgtaggtaggcctgtgccgcaaacaagcttaccatggaactcctcatcctcaaagccaacgccataaccacaatactcaccgccgtaaccttctgctttgcgtcgggacaaaacatcaccgaagagttctaccaatccacttgctccgcagtaagcaaaggatacctctccgccctgcgaaccggttggtacacatcagtcatcacaatcgaactctcaaacataaaagaaaacaaatgcaacggcaccgacgcaaaggtcaaattaatcaagcaagaactagacaaatacaaaaacgccgtcacagaactccagctgctaatgcagagcacacccgcaactggcagcggatccgccatcgcatcaggagtcgccgtgtgcaaagtcctacacctcgaaggagaagtgaacaaaatcaaatcagccctactctccaccaacaaggccgtcgtctccctctccggctgcggtgtctccgtcctaaccttcaaagtgctagacctcaagaactacatcgacaaacaactcctaccaatactcaacaagcaatcttgctccatctccaacatcgaaaccgtaatcgagttccaacagaagaacaaccgcctcctcgaaatcacccgcgagttctctgtcaacgcaggggtcaccactcccgtctccacatacatgctcacaaactccgaactcctcagcctcatcaacgacatgcccataaccaacgaccagaaaaagctaatgagcaataacgtccaaatcgttagacaacaaagttattccatcatgtgcatcatcaaagaagaagtcctcgcctacgtcgtacaactccccctctatggcgtcatcgacaccccctgctggaaactgcacacatcacccctctgcaccacaaacaccaaagaaggctcaaacatctgcctaactcgcaccgaccgcggctggtactgcgacaacgccggcagcgtatcattctttccccaagccgaaacatgcaaagttcaatccaaccgcgtcttctgcgacacaatgaactccagaacgctccccagcgaagtcaacctctgtaacgtagacatcttcaaccctaagtacgactgcaaaatcatgacctccaaaactgatgtatcctcctccgtcatcacatccctgggcgccatcgtcagctgctacggcaaaacaaaatgcactgcctcaaacaaatgccgaggtatcataaagaccttctcaaacggatgcgattacgtcagcaacaaaggcgtcgacaccgtcagtgtcggcaacaccctctactacgtcaacaaacaagaaggaaaatccctctacgtcaaaggcgaacccatcatcaacttctacgaccccctcgtcttccccagcgacgagttcgacgcctccatctcacaagtcaacgaaaagataaaccaatctctagccttcatccgcaaatccgatgaactcctgcataacgtcaacgccggcaaatccaccacaaacatcatgatcactaccataatcatcgtcataatcgtaatcctcctatctcttatcgcagtcggcctactactctactgcaaagcccgctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5720 - RNA, 1921 nt, synthetic construct
  misc_feature 1..1921: note = mRNA product Design a-3 comprising derived and/or modified sequence from HRSV(A2)__F-del_DSCav1_mut5 (opt1)
  source 1..1921: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5721 - RNA, 1921 nt, synthetic construct
  misc_feature 1..1921: note = mRNA product Design a-3 comprising derived and/or modified sequence from HRSV(A2)__F-del_DSCav1_mut5 (opt1)
  source 1..1921: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcgggtgcggcgtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggggtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggcgtgatcgacacgccgtgctggaagctgcacaccagccccctctgcaccaccaacacgaaggaggggtccaacatctgcctgacccgcaccgaccggggctggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggggccatcgtgtcctgctacggcaagaccaagtgcaccgccagcaacaagtgccgggggatcatcaagaccttctccaacggctgcgactacgtgagcaacaagggcgtcgacacggtgagcgtggggaacaccctctactacgtcaacaagcaggagggcaagtccctgtacgtgaagggggagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccggcaagtccaccaccaacatcatgatcaccacgatcatcatcgtgatcatcgtcatcctcctgagcctgatcgccgtggggctcctgctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5722 - RNA, 1921 nt, synthetic construct
  misc_feature 1..1921: note = mRNA product Design a-3 comprising derived and/or modified sequence from HRSV(A2)__F-del_DSCav1_mut5 (opt2)
  source 1..1921: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5723 - RNA, 1921 nt, synthetic construct
  misc_feature 1..1921: note = mRNA product Design a-3 comprising derived and/or modified sequence from HRSV(A2)__F-del_DSCav1_mut5 (opt3)
  source 1..1921: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcggttgcggggtgtccgtattaacttttaaggttctggaccttaagaactacattgataaacaattgctgcctatcctaaataagcagtcatgtagtattagcaacatcgagaccgtgatagagttccagcagaaaaataacaggctcctggaaattacacgggagttttctgtcaatgcgggagtgactaccccagtgtccacatatatgcttaccaactcagaactgttgagcctcatcaatgacatgccgattacgaacgatcaaaagaaactgatgagtaacaatgtccagatcgttcgccagcagtcttactccatcatgtgcattataaaggaggaagtgttagcatatgtagtgcaactgcccctctacggcgtcatcgacactccttgttggaaacttcatacaagcccactgtgcaccactaacacaaaggagggctcgaatatttgtttgacccgaacggatcgtgggtggtactgcgacaacgccggatctgtgtccttctttccccaggctgaaacctgtaaggttcagtcaaatagagtgttctgcgatacaatgaacagtagaactctgcctagcgaggtcaatctctgcaacgtggacatctttaatccaaaatatgattgtaagataatgacctccaaaacagacgtatctagctcagttattaccagtctgggtgccatcgtgtcctgctacggcaagactaaatgtacagcaagcaacaagtgcagggggatcattaagaccttctctaatggatgtgattatgtctcaaacaaaggcgtggacactgtcagtgtgggtaatacgctttactatgttaacaagcaagaggggaaaagcctgtacgtgaagggagaacccatcattaatttttatgaccctttggtattcccatccgatgagtttgacgcttctatatcgcaggtcaacgagaaaatcaaccagagcctcgccttcattcggaagtccgatgaactgttacacaatgtgaacgcgggcaagtcaacaaccaatatcatgatcactaccattataatcgttattatcgtgattctgctaagtctcatcgccgtcggcctgcttttgtactgcaaagcacgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5724 - RNA, 1921 nt, synthetic construct
  misc_feature 1..1921: note = mRNA product Design a-3 comprising derived and/or modified sequence from HRSV(A2)__F-del_DSCav1_mut5 (opt4)
  source 1..1921: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5725 - RNA, 1921 nt, synthetic construct
  misc_feature 1..1921: note = mRNA product Design a-3 comprising derived and/or modified sequence from HRSV(A2)__F-del_DSCav1_mut5 (opt5)
  source 1..1921: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcggatgcggcgtttctgtgctgacatttaaggtccttgacctgaagaactacattgataaacaactcctgcctatcctgaataagcagtcctgtagcatttctaacatcgagaccgtgattgagttccagcagaaaaataaccggctcctggaaatcacgcgcgagttttccgtgaatgccggcgtcacaaccccggttagcacatatatgcttaccaactccgaactgctctctctgatcaatgacatgcccattaccaacgatcaaaagaaacttatgagcaacaatgtgcagatcgtgagacagcagtcctacagcattatgtgcatcattaaggaggaagtcctggcttatgtggttcaactccctctgtacggggtgatcgacacaccctgttggaaactgcatacgtctcctctctgcaccacaaacaccaaggagggatccaatatctgtctgacacggaccgatcgcggctggtactgcgacaacgccgggagcgtctctttctttccccaggcggaaacgtgtaaggtgcagagcaatagagttttctgcgatacaatgaactccagaaccctgccttctgaggtgaatctctgcaacgtcgacatttttaatccgaaatatgattgtaagatcatgaccagcaaaacagacgtgtccagctctgtcattacctccctgggagccatcgtgagctgctacggcaagacaaaatgtacggcttctaacaagtgccgggggattatcaagaccttctccaatggatgtgattatgttagcaacaaaggcgtggacacagtctccgtgggcaataccctttactatgttaacaagcaagaggggaaatctctgtacgtgaagggagaacccatcattaatttttatgaccctctcgtcttccccagcgatgagtttgacgcctccatctctcaggtgaacgagaaaattaaccagagcctggctttcatccgcaagtccgatgaactgctccacaatgtgaacgccggcaagagcacaaccaatattatgatcacgaccattatcatcgttattatcgtcattctgctttctctgatcgccgtggggctcctgctgtactgcaaagctagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5726 - RNA, 1921 nt, synthetic construct
  misc_feature 1..1921: note = mRNA product Design a-3 comprising derived and/or modified sequence from HRSV(A2)__F-del_DSCav1_mut5 (opt6)
  source 1..1921: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaacttttaatactgaaagcaaatgccatcacaaccatactaactgccgtcacattctgctttgcatcaggacaaaacataacagaagaattttaccaatccacatgctcagcagtatcaaaaggatatctatcggcacttagaactggatggtacacaagtgttataactatagaactctcaaacataaaagaaaacaaatgcaatggaacagacgcaaaagtaaaactaataaaacaagaactcgataaatataaaaatgcagtaaccgaactacaactattaatgcaaagcacacccgcaacaggcagcggatcagcaatagcaagcggagtcgcagtatgtaaagtactacatctagaaggagaagtcaacaaaatcaaatctgcacttctatccacaaacaaagctgtagtatccctatccggatgcggagtctcagtattaacttttaaagtactagaccttaaaaactacatagataaacaactattaccaatactaaataaacaatcatgcagcatatccaatatagagacagtaattgaatttcaacaaaaaaacaacagattactagaaattactcgtgaattttccgtaaatgccggagtcacaacaccagtatcaacctatatgctaacaaacagcgaactacttagcttaataaatgacatgccaataacaaatgaccaaaaaaaacttatgtcaaataacgtacaaatcgtcagacaacaatcctactctataatgtgtataattaaagaagaagtcctagcatacgtagttcaattaccactctatggagtaatagatacaccatgctggaaactacacacgtcaccactatgtacaacaaacacaaaagaaggatccaatatatgcctaacaagaaccgacagaggctggtattgtgacaacgcaggatccgtttcattcttcccacaagcagaaacctgtaaagtacaatctaatagagtattttgcgacacaatgaacagtagaacactaccaagcgaggttaatctatgtaacgtagacatattcaatccaaaatatgattgcaaaataatgacatcaaaaacagatgtatcgtcgagtgtaataacaagtctgggagctatagtaagctgctacggcaagacgaaatgtaccgcttcaaataaatgcagaggaatcattaaaacattctcgaacggatgcgactacgtaagtaataaaggtgtcgacaccgtatcagtagggaatacattatactacgtcaacaaacaagaaggaaaatctctatatgtaaaaggagaaccaataataaatttctatgaccctctagtattcccatcagatgaatttgacgcttccatatcacaagtaaacgaaaaaatcaatcaatctttagcattcatacgaaaaagtgatgaactcctacacaacgtcaacgcaggaaaaagcacaacaaatataatgatcacaacaatcatcatagtaataatagtaatactactatcattaatagcagtaggattattgctttactgcaaagcacgatagggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5727 - RNA, 1921 nt, synthetic construct
  misc_feature 1..1921: note = mRNA product Design a-3 comprising derived and/or modified sequence from HRSV(A2)__F-del_DSCav1_mut5 (opt11)
  source 1..1921: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcctcatcctcaaagccaacgccataaccacaatactcaccgccgtaaccttctgctttgcgtcgggacaaaacatcaccgaagagttctaccaatccacttgctccgcagtaagcaaaggatacctctccgccctgcgaaccggttggtacacatcagtcatcacaatcgaactctcaaacataaaagaaaacaaatgcaacggcaccgacgcaaaggtcaaattaatcaagcaagaactagacaaatacaaaaacgccgtcacagaactccagctgctaatgcagagcacacccgcaactggcagcggatccgccatcgcatcaggagtcgccgtgtgcaaagtcctacacctcgaaggagaagtgaacaaaatcaaatcagccctactctccaccaacaaggccgtcgtctccctctccggctgcggtgtctccgtcctaaccttcaaagtgctagacctcaagaactacatcgacaaacaactcctaccaatactcaacaagcaatcttgctccatctccaacatcgaaaccgtaatcgagttccaacagaagaacaaccgcctcctcgaaatcacccgcgagttctctgtcaacgcaggggtcaccactcccgtctccacatacatgctcacaaactccgaactcctcagcctcatcaacgacatgcccataaccaacgaccagaaaaagctaatgagcaataacgtccaaatcgttagacaacaaagttattccatcatgtgcatcatcaaagaagaagtcctcgcctacgtcgtacaactccccctctatggcgtcatcgacaccccctgctggaaactgcacacatcacccctctgcaccacaaacaccaaagaaggctcaaacatctgcctaactcgcaccgaccgcggctggtactgcgacaacgccggcagcgtatcattctttccccaagccgaaacatgcaaagttcaatccaaccgcgtcttctgcgacacaatgaactccagaacgctccccagcgaagtcaacctctgtaacgtagacatcttcaaccctaagtacgactgcaaaatcatgacctccaaaactgatgtatcctcctccgtcatcacatccctgggcgccatcgtcagctgctacggcaaaacaaaatgcactgcctcaaacaaatgccgaggtatcataaagaccttctcaaacggatgcgattacgtcagcaacaaaggcgtcgacaccgtcagtgtcggcaacaccctctactacgtcaacaaacaagaaggaaaatccctctacgtcaaaggcgaacccatcatcaacttctacgaccccctcgtcttccccagcgacgagttcgacgcctccatctcacaagtcaacgaaaagataaaccaatctctagccttcatccgcaaatccgatgaactcctgcataacgtcaacgccggcaaatccaccacaaacatcatgatcactaccataatcatcgtcataatcgtaatcctcctatctcttatcgcagtcggcctactactctactgcaaagcccgctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5728 - RNA, 1870 nt, synthetic construct
  misc_feature 1..1870: note = mRNA product Design a-4 comprising derived and/or modified sequence from HRSV(A2)__F-del_DSCav1_mut5 (opt1)
  source 1..1870: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5729 - RNA, 1870 nt, synthetic construct
  misc_feature 1..1870: note = mRNA product Design a-4 comprising derived and/or modified sequence from HRSV(A2)__F-del_DSCav1_mut5 (opt1)
  source 1..1870: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcgggtgcggcgtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggggtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggcgtgatcgacacgccgtgctggaagctgcacaccagccccctctgcaccaccaacacgaaggaggggtccaacatctgcctgacccgcaccgaccggggctggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggggccatcgtgtcctgctacggcaagaccaagtgcaccgccagcaacaagtgccgggggatcatcaagaccttctccaacggctgcgactacgtgagcaacaagggcgtcgacacggtgagcgtggggaacaccctctactacgtcaacaagcaggagggcaagtccctgtacgtgaagggggagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccggcaagtccaccaccaacatcatgatcaccacgatcatcatcgtgatcatcgtcatcctcctgagcctgatcgccgtggggctcctgctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5730 - RNA, 1870 nt, synthetic construct
  misc_feature 1..1870: note = mRNA product Design a-4 comprising derived and/or modified sequence from HRSV(A2)__F-del_DSCav1_mut5 (opt2)
  source 1..1870: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5731 - RNA, 1870 nt, synthetic construct
  misc_feature 1..1870: note = mRNA product Design a-4 comprising derived and/or modified sequence from HRSV(A2)__F-del_DSCav1_mut5 (opt3)
  source 1..1870: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcggttgcggggtgtccgtattaacttttaaggttctggaccttaagaactacattgataaacaattgctgcctatcctaaataagcagtcatgtagtattagcaacatcgagaccgtgatagagttccagcagaaaaataacaggctcctggaaattacacgggagttttctgtcaatgcgggagtgactaccccagtgtccacatatatgcttaccaactcagaactgttgagcctcatcaatgacatgccgattacgaacgatcaaaagaaactgatgagtaacaatgtccagatcgttcgccagcagtcttactccatcatgtgcattataaaggaggaagtgttagcatatgtagtgcaactgcccctctacggcgtcatcgacactccttgttggaaacttcatacaagcccactgtgcaccactaacacaaaggagggctcgaatatttgtttgacccgaacggatcgtgggtggtactgcgacaacgccggatctgtgtccttctttccccaggctgaaacctgtaaggttcagtcaaatagagtgttctgcgatacaatgaacagtagaactctgcctagcgaggtcaatctctgcaacgtggacatctttaatccaaaatatgattgtaagataatgacctccaaaacagacgtatctagctcagttattaccagtctgggtgccatcgtgtcctgctacggcaagactaaatgtacagcaagcaacaagtgcagggggatcattaagaccttctctaatggatgtgattatgtctcaaacaaaggcgtggacactgtcagtgtgggtaatacgctttactatgttaacaagcaagaggggaaaagcctgtacgtgaagggagaacccatcattaatttttatgaccctttggtattcccatccgatgagtttgacgcttctatatcgcaggtcaacgagaaaatcaaccagagcctcgccttcattcggaagtccgatgaactgttacacaatgtgaacgcgggcaagtcaacaaccaatatcatgatcactaccattataatcgttattatcgtgattctgctaagtctcatcgccgtcggcctgcttttgtactgcaaagcacgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5732 - RNA, 1870 nt, synthetic construct
  misc_feature 1..1870: note = mRNA product Design a-4 comprising derived and/or modified sequence from HRSV(A2)__F-del_DSCav1_mut5 (opt4)
  source 1..1870: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5733 - RNA, 1870 nt, synthetic construct
  misc_feature 1..1870: note = mRNA product Design a-4 comprising derived and/or modified sequence from HRSV(A2)__F-del_DSCav1_mut5 (opt5)
  source 1..1870: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcggatgcggcgtttctgtgctgacatttaaggtccttgacctgaagaactacattgataaacaactcctgcctatcctgaataagcagtcctgtagcatttctaacatcgagaccgtgattgagttccagcagaaaaataaccggctcctggaaatcacgcgcgagttttccgtgaatgccggcgtcacaaccccggttagcacatatatgcttaccaactccgaactgctctctctgatcaatgacatgcccattaccaacgatcaaaagaaacttatgagcaacaatgtgcagatcgtgagacagcagtcctacagcattatgtgcatcattaaggaggaagtcctggcttatgtggttcaactccctctgtacggggtgatcgacacaccctgttggaaactgcatacgtctcctctctgcaccacaaacaccaaggagggatccaatatctgtctgacacggaccgatcgcggctggtactgcgacaacgccgggagcgtctctttctttccccaggcggaaacgtgtaaggtgcagagcaatagagttttctgcgatacaatgaactccagaaccctgccttctgaggtgaatctctgcaacgtcgacatttttaatccgaaatatgattgtaagatcatgaccagcaaaacagacgtgtccagctctgtcattacctccctgggagccatcgtgagctgctacggcaagacaaaatgtacggcttctaacaagtgccgggggattatcaagaccttctccaatggatgtgattatgttagcaacaaaggcgtggacacagtctccgtgggcaataccctttactatgttaacaagcaagaggggaaatctctgtacgtgaagggagaacccatcattaatttttatgaccctctcgtcttccccagcgatgagtttgacgcctccatctctcaggtgaacgagaaaattaaccagagcctggctttcatccgcaagtccgatgaactgctccacaatgtgaacgccggcaagagcacaaccaatattatgatcacgaccattatcatcgttattatcgtcattctgctttctctgatcgccgtggggctcctgctgtactgcaaagctagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5734 - RNA, 1870 nt, synthetic construct
  misc_feature 1..1870: note = mRNA product Design a-4 comprising derived and/or modified sequence from HRSV(A2)__F-del_DSCav1_mut5 (opt6)
  source 1..1870: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaacttttaatactgaaagcaaatgccatcacaaccatactaactgccgtcacattctgctttgcatcaggacaaaacataacagaagaattttaccaatccacatgctcagcagtatcaaaaggatatctatcggcacttagaactggatggtacacaagtgttataactatagaactctcaaacataaaagaaaacaaatgcaatggaacagacgcaaaagtaaaactaataaaacaagaactcgataaatataaaaatgcagtaaccgaactacaactattaatgcaaagcacacccgcaacaggcagcggatcagcaatagcaagcggagtcgcagtatgtaaagtactacatctagaaggagaagtcaacaaaatcaaatctgcacttctatccacaaacaaagctgtagtatccctatccggatgcggagtctcagtattaacttttaaagtactagaccttaaaaactacatagataaacaactattaccaatactaaataaacaatcatgcagcatatccaatatagagacagtaattgaatttcaacaaaaaaacaacagattactagaaattactcgtgaattttccgtaaatgccggagtcacaacaccagtatcaacctatatgctaacaaacagcgaactacttagcttaataaatgacatgccaataacaaatgaccaaaaaaaacttatgtcaaataacgtacaaatcgtcagacaacaatcctactctataatgtgtataattaaagaagaagtcctagcatacgtagttcaattaccactctatggagtaatagatacaccatgctggaaactacacacgtcaccactatgtacaacaaacacaaaagaaggatccaatatatgcctaacaagaaccgacagaggctggtattgtgacaacgcaggatccgtttcattcttcccacaagcagaaacctgtaaagtacaatctaatagagtattttgcgacacaatgaacagtagaacactaccaagcgaggttaatctatgtaacgtagacatattcaatccaaaatatgattgcaaaataatgacatcaaaaacagatgtatcgtcgagtgtaataacaagtctgggagctatagtaagctgctacggcaagacgaaatgtaccgcttcaaataaatgcagaggaatcattaaaacattctcgaacggatgcgactacgtaagtaataaaggtgtcgacaccgtatcagtagggaatacattatactacgtcaacaaacaagaaggaaaatctctatatgtaaaaggagaaccaataataaatttctatgaccctctagtattcccatcagatgaatttgacgcttccatatcacaagtaaacgaaaaaatcaatcaatctttagcattcatacgaaaaagtgatgaactcctacacaacgtcaacgcaggaaaaagcacaacaaatataatgatcacaacaatcatcatagtaataatagtaatactactatcattaatagcagtaggattattgctttactgcaaagcacgatagggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5735 - RNA, 1870 nt, synthetic construct
  misc_feature 1..1870: note = mRNA product Design a-4 comprising derived and/or modified sequence from HRSV(A2)__F-del_DSCav1_mut5 (opt11)
  source 1..1870: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactcctcatcctcaaagccaacgccataaccacaatactcaccgccgtaaccttctgctttgcgtcgggacaaaacatcaccgaagagttctaccaatccacttgctccgcagtaagcaaaggatacctctccgccctgcgaaccggttggtacacatcagtcatcacaatcgaactctcaaacataaaagaaaacaaatgcaacggcaccgacgcaaaggtcaaattaatcaagcaagaactagacaaatacaaaaacgccgtcacagaactccagctgctaatgcagagcacacccgcaactggcagcggatccgccatcgcatcaggagtcgccgtgtgcaaagtcctacacctcgaaggagaagtgaacaaaatcaaatcagccctactctccaccaacaaggccgtcgtctccctctccggctgcggtgtctccgtcctaaccttcaaagtgctagacctcaagaactacatcgacaaacaactcctaccaatactcaacaagcaatcttgctccatctccaacatcgaaaccgtaatcgagttccaacagaagaacaaccgcctcctcgaaatcacccgcgagttctctgtcaacgcaggggtcaccactcccgtctccacatacatgctcacaaactccgaactcctcagcctcatcaacgacatgcccataaccaacgaccagaaaaagctaatgagcaataacgtccaaatcgttagacaacaaagttattccatcatgtgcatcatcaaagaagaagtcctcgcctacgtcgtacaactccccctctatggcgtcatcgacaccccctgctggaaactgcacacatcacccctctgcaccacaaacaccaaagaaggctcaaacatctgcctaactcgcaccgaccgcggctggtactgcgacaacgccggcagcgtatcattctttccccaagccgaaacatgcaaagttcaatccaaccgcgtcttctgcgacacaatgaactccagaacgctccccagcgaagtcaacctctgtaacgtagacatcttcaaccctaagtacgactgcaaaatcatgacctccaaaactgatgtatcctcctccgtcatcacatccctgggcgccatcgtcagctgctacggcaaaacaaaatgcactgcctcaaacaaatgccgaggtatcataaagaccttctcaaacggatgcgattacgtcagcaacaaaggcgtcgacaccgtcagtgtcggcaacaccctctactacgtcaacaaacaagaaggaaaatccctctacgtcaaaggcgaacccatcatcaacttctacgaccccctcgtcttccccagcgacgagttcgacgcctccatctcacaagtcaacgaaaagataaaccaatctctagccttcatccgcaaatccgatgaactcctgcataacgtcaacgccggcaaatccaccacaaacatcatgatcactaccataatcatcgtcataatcgtaatcctcctatctcttatcgcagtcggcctactactctactgcaaagcccgctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5736 - RNA, 1816 nt, synthetic construct
  misc_feature 1..1816: note = mRNA product Design a-5 comprising derived and/or modified sequence from HRSV(A2)__F-del_DSCav1_mut5 (opt1)
  source 1..1816: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5737 - RNA, 1816 nt, synthetic construct
  misc_feature 1..1816: note = mRNA product Design a-5 comprising derived and/or modified sequence from HRSV(A2)__F-del_DSCav1_mut5 (opt1)
  source 1..1816: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcgggtgcggcgtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggggtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggcgtgatcgacacgccgtgctggaagctgcacaccagccccctctgcaccaccaacacgaaggaggggtccaacatctgcctgacccgcaccgaccggggctggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggggccatcgtgtcctgctacggcaagaccaagtgcaccgccagcaacaagtgccgggggatcatcaagaccttctccaacggctgcgactacgtgagcaacaagggcgtcgacacggtgagcgtggggaacaccctctactacgtcaacaagcaggagggcaagtccctgtacgtgaagggggagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccggcaagtccaccaccaacatcatgatcaccacgatcatcatcgtgatcatcgtcatcctcctgagcctgatcgccgtggggctcctgctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5738 - RNA, 1816 nt, synthetic construct
  misc_feature 1..1816: note = mRNA product Design a-5 comprising derived and/or modified sequence from HRSV(A2)__F-del_DSCav1_mut5 (opt2)
  source 1..1816: mol_type = other RNA
gggagactttcccattctgtagcagaatttggtgttgcctgtggtcttggtcccgcggagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5739 - RNA, 1816 nt, synthetic construct
  misc_feature 1..1816: note = mRNA product Design a-5 comprising derived and/or modified sequence from HRSV(A2)__F-del_DSCav1_mut5 (opt3)
  source 1..1816: mol_type = other RNA
gggagactttcccattctgtagcagaatttggtgttgcctgtggtcttggtcccgcggagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcggttgcggggtgtccgtattaacttttaaggttctggaccttaagaactacattgataaacaattgctgcctatcctaaataagcagtcatgtagtattagcaacatcgagaccgtgatagagttccagcagaaaaataacaggctcctggaaattacacgggagttttctgtcaatgcgggagtgactaccccagtgtccacatatatgcttaccaactcagaactgttgagcctcatcaatgacatgccgattacgaacgatcaaaagaaactgatgagtaacaatgtccagatcgttcgccagcagtcttactccatcatgtgcattataaaggaggaagtgttagcatatgtagtgcaactgcccctctacggcgtcatcgacactccttgttggaaacttcatacaagcccactgtgcaccactaacacaaaggagggctcgaatatttgtttgacccgaacggatcgtgggtggtactgcgacaacgccggatctgtgtccttctttccccaggctgaaacctgtaaggttcagtcaaatagagtgttctgcgatacaatgaacagtagaactctgcctagcgaggtcaatctctgcaacgtggacatctttaatccaaaatatgattgtaagataatgacctccaaaacagacgtatctagctcagttattaccagtctgggtgccatcgtgtcctgctacggcaagactaaatgtacagcaagcaacaagtgcagggggatcattaagaccttctctaatggatgtgattatgtctcaaacaaaggcgtggacactgtcagtgtgggtaatacgctttactatgttaacaagcaagaggggaaaagcctgtacgtgaagggagaacccatcattaatttttatgaccctttggtattcccatccgatgagtttgacgcttctatatcgcaggtcaacgagaaaatcaaccagagcctcgccttcattcggaagtccgatgaactgttacacaatgtgaacgcgggcaagtcaacaaccaatatcatgatcactaccattataatcgttattatcgtgattctgctaagtctcatcgccgtcggcctgcttttgtactgcaaagcacgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5740 - RNA, 1816 nt, synthetic construct
  misc_feature 1..1816: note = mRNA product Design a-5 comprising derived and/or modified sequence from HRSV(A2)__F-del_DSCav1_mut5 (opt4)
  source 1..1816: mol_type = other RNA
gggagactttcccattctgtagcagaatttggtgttgcctgtggtcttggtcccgcggagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5741 - RNA, 1816 nt, synthetic construct
  misc_feature 1..1816: note = mRNA product Design a-5 comprising derived and/or modified sequence from HRSV(A2)__F-del_DSCav1_mut5 (opt5)
  source 1..1816: mol_type = other RNA
gggagactttcccattctgtagcagaatttggtgttgcctgtggtcttggtcccgcggagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcggatgcggcgtttctgtgctgacatttaaggtccttgacctgaagaactacattgataaacaactcctgcctatcctgaataagcagtcctgtagcatttctaacatcgagaccgtgattgagttccagcagaaaaataaccggctcctggaaatcacgcgcgagttttccgtgaatgccggcgtcacaaccccggttagcacatatatgcttaccaactccgaactgctctctctgatcaatgacatgcccattaccaacgatcaaaagaaacttatgagcaacaatgtgcagatcgtgagacagcagtcctacagcattatgtgcatcattaaggaggaagtcctggcttatgtggttcaactccctctgtacggggtgatcgacacaccctgttggaaactgcatacgtctcctctctgcaccacaaacaccaaggagggatccaatatctgtctgacacggaccgatcgcggctggtactgcgacaacgccgggagcgtctctttctttccccaggcggaaacgtgtaaggtgcagagcaatagagttttctgcgatacaatgaactccagaaccctgccttctgaggtgaatctctgcaacgtcgacatttttaatccgaaatatgattgtaagatcatgaccagcaaaacagacgtgtccagctctgtcattacctccctgggagccatcgtgagctgctacggcaagacaaaatgtacggcttctaacaagtgccgggggattatcaagaccttctccaatggatgtgattatgttagcaacaaaggcgtggacacagtctccgtgggcaataccctttactatgttaacaagcaagaggggaaatctctgtacgtgaagggagaacccatcattaatttttatgaccctctcgtcttccccagcgatgagtttgacgcctccatctctcaggtgaacgagaaaattaaccagagcctggctttcatccgcaagtccgatgaactgctccacaatgtgaacgccggcaagagcacaaccaatattatgatcacgaccattatcatcgttattatcgtcattctgctttctctgatcgccgtggggctcctgctgtactgcaaagctagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5742 - RNA, 1816 nt, synthetic construct
  misc_feature 1..1816: note = mRNA product Design a-5 comprising derived and/or modified sequence from HRSV(A2)__F-del_DSCav1_mut5 (opt6)
  source 1..1816: mol_type = other RNA
gggagactttcccattctgtagcagaatttggtgttgcctgtggtcttggtcccgcggagaagcttaccatggaacttttaatactgaaagcaaatgccatcacaaccatactaactgccgtcacattctgctttgcatcaggacaaaacataacagaagaattttaccaatccacatgctcagcagtatcaaaaggatatctatcggcacttagaactggatggtacacaagtgttataactatagaactctcaaacataaaagaaaacaaatgcaatggaacagacgcaaaagtaaaactaataaaacaagaactcgataaatataaaaatgcagtaaccgaactacaactattaatgcaaagcacacccgcaacaggcagcggatcagcaatagcaagcggagtcgcagtatgtaaagtactacatctagaaggagaagtcaacaaaatcaaatctgcacttctatccacaaacaaagctgtagtatccctatccggatgcggagtctcagtattaacttttaaagtactagaccttaaaaactacatagataaacaactattaccaatactaaataaacaatcatgcagcatatccaatatagagacagtaattgaatttcaacaaaaaaacaacagattactagaaattactcgtgaattttccgtaaatgccggagtcacaacaccagtatcaacctatatgctaacaaacagcgaactacttagcttaataaatgacatgccaataacaaatgaccaaaaaaaacttatgtcaaataacgtacaaatcgtcagacaacaatcctactctataatgtgtataattaaagaagaagtcctagcatacgtagttcaattaccactctatggagtaatagatacaccatgctggaaactacacacgtcaccactatgtacaacaaacacaaaagaaggatccaatatatgcctaacaagaaccgacagaggctggtattgtgacaacgcaggatccgtttcattcttcccacaagcagaaacctgtaaagtacaatctaatagagtattttgcgacacaatgaacagtagaacactaccaagcgaggttaatctatgtaacgtagacatattcaatccaaaatatgattgcaaaataatgacatcaaaaacagatgtatcgtcgagtgtaataacaagtctgggagctatagtaagctgctacggcaagacgaaatgtaccgcttcaaataaatgcagaggaatcattaaaacattctcgaacggatgcgactacgtaagtaataaaggtgtcgacaccgtatcagtagggaatacattatactacgtcaacaaacaagaaggaaaatctctatatgtaaaaggagaaccaataataaatttctatgaccctctagtattcccatcagatgaatttgacgcttccatatcacaagtaaacgaaaaaatcaatcaatctttagcattcatacgaaaaagtgatgaactcctacacaacgtcaacgcaggaaaaagcacaacaaatataatgatcacaacaatcatcatagtaataatagtaatactactatcattaatagcagtaggattattgctttactgcaaagcacgatagggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5743 - RNA, 1816 nt, synthetic construct
  misc_feature 1..1816: note = mRNA product Design a-5 comprising derived and/or modified sequence from HRSV(A2)__F-del_DSCav1_mut5 (opt11)
  source 1..1816: mol_type = other RNA
gggagactttcccattctgtagcagaatttggtgttgcctgtggtcttggtcccgcggagaagcttaccatggaactcctcatcctcaaagccaacgccataaccacaatactcaccgccgtaaccttctgctttgcgtcgggacaaaacatcaccgaagagttctaccaatccacttgctccgcagtaagcaaaggatacctctccgccctgcgaaccggttggtacacatcagtcatcacaatcgaactctcaaacataaaagaaaacaaatgcaacggcaccgacgcaaaggtcaaattaatcaagcaagaactagacaaatacaaaaacgccgtcacagaactccagctgctaatgcagagcacacccgcaactggcagcggatccgccatcgcatcaggagtcgccgtgtgcaaagtcctacacctcgaaggagaagtgaacaaaatcaaatcagccctactctccaccaacaaggccgtcgtctccctctccggctgcggtgtctccgtcctaaccttcaaagtgctagacctcaagaactacatcgacaaacaactcctaccaatactcaacaagcaatcttgctccatctccaacatcgaaaccgtaatcgagttccaacagaagaacaaccgcctcctcgaaatcacccgcgagttctctgtcaacgcaggggtcaccactcccgtctccacatacatgctcacaaactccgaactcctcagcctcatcaacgacatgcccataaccaacgaccagaaaaagctaatgagcaataacgtccaaatcgttagacaacaaagttattccatcatgtgcatcatcaaagaagaagtcctcgcctacgtcgtacaactccccctctatggcgtcatcgacaccccctgctggaaactgcacacatcacccctctgcaccacaaacaccaaagaaggctcaaacatctgcctaactcgcaccgaccgcggctggtactgcgacaacgccggcagcgtatcattctttccccaagccgaaacatgcaaagttcaatccaaccgcgtcttctgcgacacaatgaactccagaacgctccccagcgaagtcaacctctgtaacgtagacatcttcaaccctaagtacgactgcaaaatcatgacctccaaaactgatgtatcctcctccgtcatcacatccctgggcgccatcgtcagctgctacggcaaaacaaaatgcactgcctcaaacaaatgccgaggtatcataaagaccttctcaaacggatgcgattacgtcagcaacaaaggcgtcgacaccgtcagtgtcggcaacaccctctactacgtcaacaaacaagaaggaaaatccctctacgtcaaaggcgaacccatcatcaacttctacgaccccctcgtcttccccagcgacgagttcgacgcctccatctcacaagtcaacgaaaagataaaccaatctctagccttcatccgcaaatccgatgaactcctgcataacgtcaacgccggcaaatccaccacaaacatcatgatcactaccataatcatcgtcataatcgtaatcctcctatctcttatcgcagtcggcctactactctactgcaaagcccgctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5744 - RNA, 1997 nt, synthetic construct
  misc_feature 1..1997: note = mRNA product Design b-1 comprising derived and/or modified sequence from HRSV(A2)__F-del_DSCav1_mut5 (opt1)
  source 1..1997: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5745 - RNA, 1997 nt, synthetic construct
  misc_feature 1..1997: note = mRNA product Design b-1 comprising derived and/or modified sequence from HRSV(A2)__F-del_DSCav1_mut5 (opt1)
  source 1..1997: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcgggtgcggcgtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggggtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggcgtgatcgacacgccgtgctggaagctgcacaccagccccctctgcaccaccaacacgaaggaggggtccaacatctgcctgacccgcaccgaccggggctggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggggccatcgtgtcctgctacggcaagaccaagtgcaccgccagcaacaagtgccgggggatcatcaagaccttctccaacggctgcgactacgtgagcaacaagggcgtcgacacggtgagcgtggggaacaccctctactacgtcaacaagcaggagggcaagtccctgtacgtgaagggggagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccggcaagtccaccaccaacatcatgatcaccacgatcatcatcgtgatcatcgtcatcctcctgagcctgatcgccgtggggctcctgctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5746 - RNA, 1997 nt, synthetic construct
  misc_feature 1..1997: note = mRNA product Design b-1 comprising derived and/or modified sequence from HRSV(A2)__F-del_DSCav1_mut5 (opt2)
  source 1..1997: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5747 - RNA, 1997 nt, synthetic construct
  misc_feature 1..1997: note = mRNA product Design b-1 comprising derived and/or modified sequence from HRSV(A2)__F-del_DSCav1_mut5 (opt3)
  source 1..1997: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcggttgcggggtgtccgtattaacttttaaggttctggaccttaagaactacattgataaacaattgctgcctatcctaaataagcagtcatgtagtattagcaacatcgagaccgtgatagagttccagcagaaaaataacaggctcctggaaattacacgggagttttctgtcaatgcgggagtgactaccccagtgtccacatatatgcttaccaactcagaactgttgagcctcatcaatgacatgccgattacgaacgatcaaaagaaactgatgagtaacaatgtccagatcgttcgccagcagtcttactccatcatgtgcattataaaggaggaagtgttagcatatgtagtgcaactgcccctctacggcgtcatcgacactccttgttggaaacttcatacaagcccactgtgcaccactaacacaaaggagggctcgaatatttgtttgacccgaacggatcgtgggtggtactgcgacaacgccggatctgtgtccttctttccccaggctgaaacctgtaaggttcagtcaaatagagtgttctgcgatacaatgaacagtagaactctgcctagcgaggtcaatctctgcaacgtggacatctttaatccaaaatatgattgtaagataatgacctccaaaacagacgtatctagctcagttattaccagtctgggtgccatcgtgtcctgctacggcaagactaaatgtacagcaagcaacaagtgcagggggatcattaagaccttctctaatggatgtgattatgtctcaaacaaaggcgtggacactgtcagtgtgggtaatacgctttactatgttaacaagcaagaggggaaaagcctgtacgtgaagggagaacccatcattaatttttatgaccctttggtattcccatccgatgagtttgacgcttctatatcgcaggtcaacgagaaaatcaaccagagcctcgccttcattcggaagtccgatgaactgttacacaatgtgaacgcgggcaagtcaacaaccaatatcatgatcactaccattataatcgttattatcgtgattctgctaagtctcatcgccgtcggcctgcttttgtactgcaaagcacgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5748 - RNA, 1997 nt, synthetic construct
  misc_feature 1..1997: note = mRNA product Design b-1 comprising derived and/or modified sequence from HRSV(A2)__F-del_DSCav1_mut5 (opt4)
  source 1..1997: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5749 - RNA, 1997 nt, synthetic construct
  misc_feature 1..1997: note = mRNA product Design b-1 comprising derived and/or modified sequence from HRSV(A2)__F-del_DSCav1_mut5 (opt5)
  source 1..1997: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcggatgcggcgtttctgtgctgacatttaaggtccttgacctgaagaactacattgataaacaactcctgcctatcctgaataagcagtcctgtagcatttctaacatcgagaccgtgattgagttccagcagaaaaataaccggctcctggaaatcacgcgcgagttttccgtgaatgccggcgtcacaaccccggttagcacatatatgcttaccaactccgaactgctctctctgatcaatgacatgcccattaccaacgatcaaaagaaacttatgagcaacaatgtgcagatcgtgagacagcagtcctacagcattatgtgcatcattaaggaggaagtcctggcttatgtggttcaactccctctgtacggggtgatcgacacaccctgttggaaactgcatacgtctcctctctgcaccacaaacaccaaggagggatccaatatctgtctgacacggaccgatcgcggctggtactgcgacaacgccgggagcgtctctttctttccccaggcggaaacgtgtaaggtgcagagcaatagagttttctgcgatacaatgaactccagaaccctgccttctgaggtgaatctctgcaacgtcgacatttttaatccgaaatatgattgtaagatcatgaccagcaaaacagacgtgtccagctctgtcattacctccctgggagccatcgtgagctgctacggcaagacaaaatgtacggcttctaacaagtgccgggggattatcaagaccttctccaatggatgtgattatgttagcaacaaaggcgtggacacagtctccgtgggcaataccctttactatgttaacaagcaagaggggaaatctctgtacgtgaagggagaacccatcattaatttttatgaccctctcgtcttccccagcgatgagtttgacgcctccatctctcaggtgaacgagaaaattaaccagagcctggctttcatccgcaagtccgatgaactgctccacaatgtgaacgccggcaagagcacaaccaatattatgatcacgaccattatcatcgttattatcgtcattctgctttctctgatcgccgtggggctcctgctgtactgcaaagctagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5750 - RNA, 1997 nt, synthetic construct
  misc_feature 1..1997: note = mRNA product Design b-1 comprising derived and/or modified sequence from HRSV(A2)__F-del_DSCav1_mut5 (opt6)
  source 1..1997: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggaacttttaatactgaaagcaaatgccatcacaaccatactaactgccgtcacattctgctttgcatcaggacaaaacataacagaagaattttaccaatccacatgctcagcagtatcaaaaggatatctatcggcacttagaactggatggtacacaagtgttataactatagaactctcaaacataaaagaaaacaaatgcaatggaacagacgcaaaagtaaaactaataaaacaagaactcgataaatataaaaatgcagtaaccgaactacaactattaatgcaaagcacacccgcaacaggcagcggatcagcaatagcaagcggagtcgcagtatgtaaagtactacatctagaaggagaagtcaacaaaatcaaatctgcacttctatccacaaacaaagctgtagtatccctatccggatgcggagtctcagtattaacttttaaagtactagaccttaaaaactacatagataaacaactattaccaatactaaataaacaatcatgcagcatatccaatatagagacagtaattgaatttcaacaaaaaaacaacagattactagaaattactcgtgaattttccgtaaatgccggagtcacaacaccagtatcaacctatatgctaacaaacagcgaactacttagcttaataaatgacatgccaataacaaatgaccaaaaaaaacttatgtcaaataacgtacaaatcgtcagacaacaatcctactctataatgtgtataattaaagaagaagtcctagcatacgtagttcaattaccactctatggagtaatagatacaccatgctggaaactacacacgtcaccactatgtacaacaaacacaaaagaaggatccaatatatgcctaacaagaaccgacagaggctggtattgtgacaacgcaggatccgtttcattcttcccacaagcagaaacctgtaaagtacaatctaatagagtattttgcgacacaatgaacagtagaacactaccaagcgaggttaatctatgtaacgtagacatattcaatccaaaatatgattgcaaaataatgacatcaaaaacagatgtatcgtcgagtgtaataacaagtctgggagctatagtaagctgctacggcaagacgaaatgtaccgcttcaaataaatgcagaggaatcattaaaacattctcgaacggatgcgactacgtaagtaataaaggtgtcgacaccgtatcagtagggaatacattatactacgtcaacaaacaagaaggaaaatctctatatgtaaaaggagaaccaataataaatttctatgaccctctagtattcccatcagatgaatttgacgcttccatatcacaagtaaacgaaaaaatcaatcaatctttagcattcatacgaaaaagtgatgaactcctacacaacgtcaacgcaggaaaaagcacaacaaatataatgatcacaacaatcatcatagtaataatagtaatactactatcattaatagcagtaggattattgctttactgcaaagcacgatagggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5751 - RNA, 1997 nt, synthetic construct
  misc_feature 1..1997: note = mRNA product Design b-1 comprising derived and/or modified sequence from HRSV(A2)__F-del_DSCav1_mut5 (opt11)
  source 1..1997: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggaactcctcatcctcaaagccaacgccataaccacaatactcaccgccgtaaccttctgctttgcgtcgggacaaaacatcaccgaagagttctaccaatccacttgctccgcagtaagcaaaggatacctctccgccctgcgaaccggttggtacacatcagtcatcacaatcgaactctcaaacataaaagaaaacaaatgcaacggcaccgacgcaaaggtcaaattaatcaagcaagaactagacaaatacaaaaacgccgtcacagaactccagctgctaatgcagagcacacccgcaactggcagcggatccgccatcgcatcaggagtcgccgtgtgcaaagtcctacacctcgaaggagaagtgaacaaaatcaaatcagccctactctccaccaacaaggccgtcgtctccctctccggctgcggtgtctccgtcctaaccttcaaagtgctagacctcaagaactacatcgacaaacaactcctaccaatactcaacaagcaatcttgctccatctccaacatcgaaaccgtaatcgagttccaacagaagaacaaccgcctcctcgaaatcacccgcgagttctctgtcaacgcaggggtcaccactcccgtctccacatacatgctcacaaactccgaactcctcagcctcatcaacgacatgcccataaccaacgaccagaaaaagctaatgagcaataacgtccaaatcgttagacaacaaagttattccatcatgtgcatcatcaaagaagaagtcctcgcctacgtcgtacaactccccctctatggcgtcatcgacaccccctgctggaaactgcacacatcacccctctgcaccacaaacaccaaagaaggctcaaacatctgcctaactcgcaccgaccgcggctggtactgcgacaacgccggcagcgtatcattctttccccaagccgaaacatgcaaagttcaatccaaccgcgtcttctgcgacacaatgaactccagaacgctccccagcgaagtcaacctctgtaacgtagacatcttcaaccctaagtacgactgcaaaatcatgacctccaaaactgatgtatcctcctccgtcatcacatccctgggcgccatcgtcagctgctacggcaaaacaaaatgcactgcctcaaacaaatgccgaggtatcataaagaccttctcaaacggatgcgattacgtcagcaacaaaggcgtcgacaccgtcagtgtcggcaacaccctctactacgtcaacaaacaagaaggaaaatccctctacgtcaaaggcgaacccatcatcaacttctacgaccccctcgtcttccccagcgacgagttcgacgcctccatctcacaagtcaacgaaaagataaaccaatctctagccttcatccgcaaatccgatgaactcctgcataacgtcaacgccggcaaatccaccacaaacatcatgatcactaccataatcatcgtcataatcgtaatcctcctatctcttatcgcagtcggcctactactctactgcaaagcccgctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5752 - RNA, 1817 nt, synthetic construct
  misc_feature 1..1817: note = mRNA product Design b-2 comprising derived and/or modified sequence from HRSV(A2)__F-del_DSCav1_mut5 (opt1)
  source 1..1817: mol_type = other RNA
gggagagcctctgctggagtccggggagtggcgttggctgctagagcgaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5753 - RNA, 1817 nt, synthetic construct
  misc_feature 1..1817: note = mRNA product Design b-2 comprising derived and/or modified sequence from HRSV(A2)__F-del_DSCav1_mut5 (opt1)
  source 1..1817: mol_type = other RNA
gggagagcctctgctggagtccggggagtggcgttggctgctagagcgaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcgggtgcggcgtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggggtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggcgtgatcgacacgccgtgctggaagctgcacaccagccccctctgcaccaccaacacgaaggaggggtccaacatctgcctgacccgcaccgaccggggctggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggggccatcgtgtcctgctacggcaagaccaagtgcaccgccagcaacaagtgccgggggatcatcaagaccttctccaacggctgcgactacgtgagcaacaagggcgtcgacacggtgagcgtggggaacaccctctactacgtcaacaagcaggagggcaagtccctgtacgtgaagggggagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccggcaagtccaccaccaacatcatgatcaccacgatcatcatcgtgatcatcgtcatcctcctgagcctgatcgccgtggggctcctgctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5754 - RNA, 1817 nt, synthetic construct
  misc_feature 1..1817: note = mRNA product Design b-2 comprising derived and/or modified sequence from HRSV(A2)__F-del_DSCav1_mut5 (opt2)
  source 1..1817: mol_type = other RNA
gggagagcctctgctggagtccggggagtggcgttggctgctagagcgaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5755 - RNA, 1817 nt, synthetic construct
  misc_feature 1..1817: note = mRNA product Design b-2 comprising derived and/or modified sequence from HRSV(A2)__F-del_DSCav1_mut5 (opt3)
  source 1..1817: mol_type = other RNA
gggagagcctctgctggagtccggggagtggcgttggctgctagagcgaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcggttgcggggtgtccgtattaacttttaaggttctggaccttaagaactacattgataaacaattgctgcctatcctaaataagcagtcatgtagtattagcaacatcgagaccgtgatagagttccagcagaaaaataacaggctcctggaaattacacgggagttttctgtcaatgcgggagtgactaccccagtgtccacatatatgcttaccaactcagaactgttgagcctcatcaatgacatgccgattacgaacgatcaaaagaaactgatgagtaacaatgtccagatcgttcgccagcagtcttactccatcatgtgcattataaaggaggaagtgttagcatatgtagtgcaactgcccctctacggcgtcatcgacactccttgttggaaacttcatacaagcccactgtgcaccactaacacaaaggagggctcgaatatttgtttgacccgaacggatcgtgggtggtactgcgacaacgccggatctgtgtccttctttccccaggctgaaacctgtaaggttcagtcaaatagagtgttctgcgatacaatgaacagtagaactctgcctagcgaggtcaatctctgcaacgtggacatctttaatccaaaatatgattgtaagataatgacctccaaaacagacgtatctagctcagttattaccagtctgggtgccatcgtgtcctgctacggcaagactaaatgtacagcaagcaacaagtgcagggggatcattaagaccttctctaatggatgtgattatgtctcaaacaaaggcgtggacactgtcagtgtgggtaatacgctttactatgttaacaagcaagaggggaaaagcctgtacgtgaagggagaacccatcattaatttttatgaccctttggtattcccatccgatgagtttgacgcttctatatcgcaggtcaacgagaaaatcaaccagagcctcgccttcattcggaagtccgatgaactgttacacaatgtgaacgcgggcaagtcaacaaccaatatcatgatcactaccattataatcgttattatcgtgattctgctaagtctcatcgccgtcggcctgcttttgtactgcaaagcacgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5756 - RNA, 1817 nt, synthetic construct
  misc_feature 1..1817: note = mRNA product Design b-2 comprising derived and/or modified sequence from HRSV(A2)__F-del_DSCav1_mut5 (opt4)
  source 1..1817: mol_type = other RNA
gggagagcctctgctggagtccggggagtggcgttggctgctagagcgaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5757 - RNA, 1817 nt, synthetic construct
  misc_feature 1..1817: note = mRNA product Design b-2 comprising derived and/or modified sequence from HRSV(A2)__F-del_DSCav1_mut5 (opt5)
  source 1..1817: mol_type = other RNA
gggagagcctctgctggagtccggggagtggcgttggctgctagagcgaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcggatgcggcgtttctgtgctgacatttaaggtccttgacctgaagaactacattgataaacaactcctgcctatcctgaataagcagtcctgtagcatttctaacatcgagaccgtgattgagttccagcagaaaaataaccggctcctggaaatcacgcgcgagttttccgtgaatgccggcgtcacaaccccggttagcacatatatgcttaccaactccgaactgctctctctgatcaatgacatgcccattaccaacgatcaaaagaaacttatgagcaacaatgtgcagatcgtgagacagcagtcctacagcattatgtgcatcattaaggaggaagtcctggcttatgtggttcaactccctctgtacggggtgatcgacacaccctgttggaaactgcatacgtctcctctctgcaccacaaacaccaaggagggatccaatatctgtctgacacggaccgatcgcggctggtactgcgacaacgccgggagcgtctctttctttccccaggcggaaacgtgtaaggtgcagagcaatagagttttctgcgatacaatgaactccagaaccctgccttctgaggtgaatctctgcaacgtcgacatttttaatccgaaatatgattgtaagatcatgaccagcaaaacagacgtgtccagctctgtcattacctccctgggagccatcgtgagctgctacggcaagacaaaatgtacggcttctaacaagtgccgggggattatcaagaccttctccaatggatgtgattatgttagcaacaaaggcgtggacacagtctccgtgggcaataccctttactatgttaacaagcaagaggggaaatctctgtacgtgaagggagaacccatcattaatttttatgaccctctcgtcttccccagcgatgagtttgacgcctccatctctcaggtgaacgagaaaattaaccagagcctggctttcatccgcaagtccgatgaactgctccacaatgtgaacgccggcaagagcacaaccaatattatgatcacgaccattatcatcgttattatcgtcattctgctttctctgatcgccgtggggctcctgctgtactgcaaagctagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5758 - RNA, 1817 nt, synthetic construct
  misc_feature 1..1817: note = mRNA product Design b-2 comprising derived and/or modified sequence from HRSV(A2)__F-del_DSCav1_mut5 (opt6)
  source 1..1817: mol_type = other RNA
gggagagcctctgctggagtccggggagtggcgttggctgctagagcgaagcttaccatggaacttttaatactgaaagcaaatgccatcacaaccatactaactgccgtcacattctgctttgcatcaggacaaaacataacagaagaattttaccaatccacatgctcagcagtatcaaaaggatatctatcggcacttagaactggatggtacacaagtgttataactatagaactctcaaacataaaagaaaacaaatgcaatggaacagacgcaaaagtaaaactaataaaacaagaactcgataaatataaaaatgcagtaaccgaactacaactattaatgcaaagcacacccgcaacaggcagcggatcagcaatagcaagcggagtcgcagtatgtaaagtactacatctagaaggagaagtcaacaaaatcaaatctgcacttctatccacaaacaaagctgtagtatccctatccggatgcggagtctcagtattaacttttaaagtactagaccttaaaaactacatagataaacaactattaccaatactaaataaacaatcatgcagcatatccaatatagagacagtaattgaatttcaacaaaaaaacaacagattactagaaattactcgtgaattttccgtaaatgccggagtcacaacaccagtatcaacctatatgctaacaaacagcgaactacttagcttaataaatgacatgccaataacaaatgaccaaaaaaaacttatgtcaaataacgtacaaatcgtcagacaacaatcctactctataatgtgtataattaaagaagaagtcctagcatacgtagttcaattaccactctatggagtaatagatacaccatgctggaaactacacacgtcaccactatgtacaacaaacacaaaagaaggatccaatatatgcctaacaagaaccgacagaggctggtattgtgacaacgcaggatccgtttcattcttcccacaagcagaaacctgtaaagtacaatctaatagagtattttgcgacacaatgaacagtagaacactaccaagcgaggttaatctatgtaacgtagacatattcaatccaaaatatgattgcaaaataatgacatcaaaaacagatgtatcgtcgagtgtaataacaagtctgggagctatagtaagctgctacggcaagacgaaatgtaccgcttcaaataaatgcagaggaatcattaaaacattctcgaacggatgcgactacgtaagtaataaaggtgtcgacaccgtatcagtagggaatacattatactacgtcaacaaacaagaaggaaaatctctatatgtaaaaggagaaccaataataaatttctatgaccctctagtattcccatcagatgaatttgacgcttccatatcacaagtaaacgaaaaaatcaatcaatctttagcattcatacgaaaaagtgatgaactcctacacaacgtcaacgcaggaaaaagcacaacaaatataatgatcacaacaatcatcatagtaataatagtaatactactatcattaatagcagtaggattattgctttactgcaaagcacgatagggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5759 - RNA, 1817 nt, synthetic construct
  misc_feature 1..1817: note = mRNA product Design b-2 comprising derived and/or modified sequence from HRSV(A2)__F-del_DSCav1_mut5 (opt11)
  source 1..1817: mol_type = other RNA
gggagagcctctgctggagtccggggagtggcgttggctgctagagcgaagcttaccatggaactcctcatcctcaaagccaacgccataaccacaatactcaccgccgtaaccttctgctttgcgtcgggacaaaacatcaccgaagagttctaccaatccacttgctccgcagtaagcaaaggatacctctccgccctgcgaaccggttggtacacatcagtcatcacaatcgaactctcaaacataaaagaaaacaaatgcaacggcaccgacgcaaaggtcaaattaatcaagcaagaactagacaaatacaaaaacgccgtcacagaactccagctgctaatgcagagcacacccgcaactggcagcggatccgccatcgcatcaggagtcgccgtgtgcaaagtcctacacctcgaaggagaagtgaacaaaatcaaatcagccctactctccaccaacaaggccgtcgtctccctctccggctgcggtgtctccgtcctaaccttcaaagtgctagacctcaagaactacatcgacaaacaactcctaccaatactcaacaagcaatcttgctccatctccaacatcgaaaccgtaatcgagttccaacagaagaacaaccgcctcctcgaaatcacccgcgagttctctgtcaacgcaggggtcaccactcccgtctccacatacatgctcacaaactccgaactcctcagcctcatcaacgacatgcccataaccaacgaccagaaaaagctaatgagcaataacgtccaaatcgttagacaacaaagttattccatcatgtgcatcatcaaagaagaagtcctcgcctacgtcgtacaactccccctctatggcgtcatcgacaccccctgctggaaactgcacacatcacccctctgcaccacaaacaccaaagaaggctcaaacatctgcctaactcgcaccgaccgcggctggtactgcgacaacgccggcagcgtatcattctttccccaagccgaaacatgcaaagttcaatccaaccgcgtcttctgcgacacaatgaactccagaacgctccccagcgaagtcaacctctgtaacgtagacatcttcaaccctaagtacgactgcaaaatcatgacctccaaaactgatgtatcctcctccgtcatcacatccctgggcgccatcgtcagctgctacggcaaaacaaaatgcactgcctcaaacaaatgccgaggtatcataaagaccttctcaaacggatgcgattacgtcagcaacaaaggcgtcgacaccgtcagtgtcggcaacaccctctactacgtcaacaaacaagaaggaaaatccctctacgtcaaaggcgaacccatcatcaacttctacgaccccctcgtcttccccagcgacgagttcgacgcctccatctcacaagtcaacgaaaagataaaccaatctctagccttcatccgcaaatccgatgaactcctgcataacgtcaacgccggcaaatccaccacaaacatcatgatcactaccataatcatcgtcataatcgtaatcctcctatctcttatcgcagtcggcctactactctactgcaaagcccgctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5760 - RNA, 1837 nt, synthetic construct
  misc_feature 1..1837: note = mRNA product Design b-3 comprising derived and/or modified sequence from HRSV(A2)__F-del_DSCav1_mut5 (opt1)
  source 1..1837: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5761 - RNA, 1837 nt, synthetic construct
  misc_feature 1..1837: note = mRNA product Design b-3 comprising derived and/or modified sequence from HRSV(A2)__F-del_DSCav1_mut5 (opt1)
  source 1..1837: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcgggtgcggcgtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggggtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggcgtgatcgacacgccgtgctggaagctgcacaccagccccctctgcaccaccaacacgaaggaggggtccaacatctgcctgacccgcaccgaccggggctggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggggccatcgtgtcctgctacggcaagaccaagtgcaccgccagcaacaagtgccgggggatcatcaagaccttctccaacggctgcgactacgtgagcaacaagggcgtcgacacggtgagcgtggggaacaccctctactacgtcaacaagcaggagggcaagtccctgtacgtgaagggggagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccggcaagtccaccaccaacatcatgatcaccacgatcatcatcgtgatcatcgtcatcctcctgagcctgatcgccgtggggctcctgctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5762 - RNA, 1837 nt, synthetic construct
  misc_feature 1..1837: note = mRNA product Design b-3 comprising derived and/or modified sequence from HRSV(A2)__F-del_DSCav1_mut5 (opt2)
  source 1..1837: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5763 - RNA, 1837 nt, synthetic construct
  misc_feature 1..1837: note = mRNA product Design b-3 comprising derived and/or modified sequence from HRSV(A2)__F-del_DSCav1_mut5 (opt3)
  source 1..1837: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcggttgcggggtgtccgtattaacttttaaggttctggaccttaagaactacattgataaacaattgctgcctatcctaaataagcagtcatgtagtattagcaacatcgagaccgtgatagagttccagcagaaaaataacaggctcctggaaattacacgggagttttctgtcaatgcgggagtgactaccccagtgtccacatatatgcttaccaactcagaactgttgagcctcatcaatgacatgccgattacgaacgatcaaaagaaactgatgagtaacaatgtccagatcgttcgccagcagtcttactccatcatgtgcattataaaggaggaagtgttagcatatgtagtgcaactgcccctctacggcgtcatcgacactccttgttggaaacttcatacaagcccactgtgcaccactaacacaaaggagggctcgaatatttgtttgacccgaacggatcgtgggtggtactgcgacaacgccggatctgtgtccttctttccccaggctgaaacctgtaaggttcagtcaaatagagtgttctgcgatacaatgaacagtagaactctgcctagcgaggtcaatctctgcaacgtggacatctttaatccaaaatatgattgtaagataatgacctccaaaacagacgtatctagctcagttattaccagtctgggtgccatcgtgtcctgctacggcaagactaaatgtacagcaagcaacaagtgcagggggatcattaagaccttctctaatggatgtgattatgtctcaaacaaaggcgtggacactgtcagtgtgggtaatacgctttactatgttaacaagcaagaggggaaaagcctgtacgtgaagggagaacccatcattaatttttatgaccctttggtattcccatccgatgagtttgacgcttctatatcgcaggtcaacgagaaaatcaaccagagcctcgccttcattcggaagtccgatgaactgttacacaatgtgaacgcgggcaagtcaacaaccaatatcatgatcactaccattataatcgttattatcgtgattctgctaagtctcatcgccgtcggcctgcttttgtactgcaaagcacgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5764 - RNA, 1837 nt, synthetic construct
  misc_feature 1..1837: note = mRNA product Design b-3 comprising derived and/or modified sequence from HRSV(A2)__F-del_DSCav1_mut5 (opt4)
  source 1..1837: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5765 - RNA, 1837 nt, synthetic construct
  misc_feature 1..1837: note = mRNA product Design b-3 comprising derived and/or modified sequence from HRSV(A2)__F-del_DSCav1_mut5 (opt5)
  source 1..1837: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcggatgcggcgtttctgtgctgacatttaaggtccttgacctgaagaactacattgataaacaactcctgcctatcctgaataagcagtcctgtagcatttctaacatcgagaccgtgattgagttccagcagaaaaataaccggctcctggaaatcacgcgcgagttttccgtgaatgccggcgtcacaaccccggttagcacatatatgcttaccaactccgaactgctctctctgatcaatgacatgcccattaccaacgatcaaaagaaacttatgagcaacaatgtgcagatcgtgagacagcagtcctacagcattatgtgcatcattaaggaggaagtcctggcttatgtggttcaactccctctgtacggggtgatcgacacaccctgttggaaactgcatacgtctcctctctgcaccacaaacaccaaggagggatccaatatctgtctgacacggaccgatcgcggctggtactgcgacaacgccgggagcgtctctttctttccccaggcggaaacgtgtaaggtgcagagcaatagagttttctgcgatacaatgaactccagaaccctgccttctgaggtgaatctctgcaacgtcgacatttttaatccgaaatatgattgtaagatcatgaccagcaaaacagacgtgtccagctctgtcattacctccctgggagccatcgtgagctgctacggcaagacaaaatgtacggcttctaacaagtgccgggggattatcaagaccttctccaatggatgtgattatgttagcaacaaaggcgtggacacagtctccgtgggcaataccctttactatgttaacaagcaagaggggaaatctctgtacgtgaagggagaacccatcattaatttttatgaccctctcgtcttccccagcgatgagtttgacgcctccatctctcaggtgaacgagaaaattaaccagagcctggctttcatccgcaagtccgatgaactgctccacaatgtgaacgccggcaagagcacaaccaatattatgatcacgaccattatcatcgttattatcgtcattctgctttctctgatcgccgtggggctcctgctgtactgcaaagctagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5766 - RNA, 1837 nt, synthetic construct
  misc_feature 1..1837: note = mRNA product Design b-3 comprising derived and/or modified sequence from HRSV(A2)__F-del_DSCav1_mut5 (opt6)
  source 1..1837: mol_type = other RNA
gggagagtcccgcagtcggcgtccagcggctctgcttgttcgtgtgtgtgtcgttgcaggccttattcaagcttaccatggaacttttaatactgaaagcaaatgccatcacaaccatactaactgccgtcacattctgctttgcatcaggacaaaacataacagaagaattttaccaatccacatgctcagcagtatcaaaaggatatctatcggcacttagaactggatggtacacaagtgttataactatagaactctcaaacataaaagaaaacaaatgcaatggaacagacgcaaaagtaaaactaataaaacaagaactcgataaatataaaaatgcagtaaccgaactacaactattaatgcaaagcacacccgcaacaggcagcggatcagcaatagcaagcggagtcgcagtatgtaaagtactacatctagaaggagaagtcaacaaaatcaaatctgcacttctatccacaaacaaagctgtagtatccctatccggatgcggagtctcagtattaacttttaaagtactagaccttaaaaactacatagataaacaactattaccaatactaaataaacaatcatgcagcatatccaatatagagacagtaattgaatttcaacaaaaaaacaacagattactagaaattactcgtgaattttccgtaaatgccggagtcacaacaccagtatcaacctatatgctaacaaacagcgaactacttagcttaataaatgacatgccaataacaaatgaccaaaaaaaacttatgtcaaataacgtacaaatcgtcagacaacaatcctactctataatgtgtataattaaagaagaagtcctagcatacgtagttcaattaccactctatggagtaatagatacaccatgctggaaactacacacgtcaccactatgtacaacaaacacaaaagaaggatccaatatatgcctaacaagaaccgacagaggctggtattgtgacaacgcaggatccgtttcattcttcccacaagcagaaacctgtaaagtacaatctaatagagtattttgcgacacaatgaacagtagaacactaccaagcgaggttaatctatgtaacgtagacatattcaatccaaaatatgattgcaaaataatgacatcaaaaacagatgtatcgtcgagtgtaataacaagtctgggagctatagtaagctgctacggcaagacgaaatgtaccgcttcaaataaatgcagaggaatcattaaaacattctcgaacggatgcgactacgtaagtaataaaggtgtcgacaccgtatcagtagggaatacattatactacgtcaacaaacaagaaggaaaatctctatatgtaaaaggagaaccaataataaatttctatgaccctctagtattcccatcagatgaatttgacgcttccatatcacaagtaaacgaaaaaatcaatcaatctttagcattcatacgaaaaagtgatgaactcctacacaacgtcaacgcaggaaaaagcacaacaaatataatgatcacaacaatcatcatagtaataatagtaatactactatcattaatagcagtaggattattgctttactgcaaagcacgatagggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5767 - RNA, 1837 nt, synthetic construct
  misc_feature 1..1837: note = mRNA product Design b-3 comprising derived and/or modified sequence from HRSV(A2)__F-del_DSCav1_mut5 (opt11)
  source 1..1837: mol_type = other RNA
gggagagtcccgcagtcggcgtccagcggctctgcttgttcgtgtgtgtgtcgttgcaggccttattcaagcttaccatggaactcctcatcctcaaagccaacgccataaccacaatactcaccgccgtaaccttctgctttgcgtcgggacaaaacatcaccgaagagttctaccaatccacttgctccgcagtaagcaaaggatacctctccgccctgcgaaccggttggtacacatcagtcatcacaatcgaactctcaaacataaaagaaaacaaatgcaacggcaccgacgcaaaggtcaaattaatcaagcaagaactagacaaatacaaaaacgccgtcacagaactccagctgctaatgcagagcacacccgcaactggcagcggatccgccatcgcatcaggagtcgccgtgtgcaaagtcctacacctcgaaggagaagtgaacaaaatcaaatcagccctactctccaccaacaaggccgtcgtctccctctccggctgcggtgtctccgtcctaaccttcaaagtgctagacctcaagaactacatcgacaaacaactcctaccaatactcaacaagcaatcttgctccatctccaacatcgaaaccgtaatcgagttccaacagaagaacaaccgcctcctcgaaatcacccgcgagttctctgtcaacgcaggggtcaccactcccgtctccacatacatgctcacaaactccgaactcctcagcctcatcaacgacatgcccataaccaacgaccagaaaaagctaatgagcaataacgtccaaatcgttagacaacaaagttattccatcatgtgcatcatcaaagaagaagtcctcgcctacgtcgtacaactccccctctatggcgtcatcgacaccccctgctggaaactgcacacatcacccctctgcaccacaaacaccaaagaaggctcaaacatctgcctaactcgcaccgaccgcggctggtactgcgacaacgccggcagcgtatcattctttccccaagccgaaacatgcaaagttcaatccaaccgcgtcttctgcgacacaatgaactccagaacgctccccagcgaagtcaacctctgtaacgtagacatcttcaaccctaagtacgactgcaaaatcatgacctccaaaactgatgtatcctcctccgtcatcacatccctgggcgccatcgtcagctgctacggcaaaacaaaatgcactgcctcaaacaaatgccgaggtatcataaagaccttctcaaacggatgcgattacgtcagcaacaaaggcgtcgacaccgtcagtgtcggcaacaccctctactacgtcaacaaacaagaaggaaaatccctctacgtcaaaggcgaacccatcatcaacttctacgaccccctcgtcttccccagcgacgagttcgacgcctccatctcacaagtcaacgaaaagataaaccaatctctagccttcatccgcaaatccgatgaactcctgcataacgtcaacgccggcaaatccaccacaaacatcatgatcactaccataatcatcgtcataatcgtaatcctcctatctcttatcgcagtcggcctactactctactgcaaagcccgctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5768 - RNA, 1888 nt, synthetic construct
  misc_feature 1..1888: note = mRNA product Design b-4 comprising derived and/or modified sequence from HRSV(A2)__F-del_DSCav1_mut5 (opt1)
  source 1..1888: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5769 - RNA, 1888 nt, synthetic construct
  misc_feature 1..1888: note = mRNA product Design b-4 comprising derived and/or modified sequence from HRSV(A2)__F-del_DSCav1_mut5 (opt1)
  source 1..1888: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcgggtgcggcgtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggggtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggcgtgatcgacacgccgtgctggaagctgcacaccagccccctctgcaccaccaacacgaaggaggggtccaacatctgcctgacccgcaccgaccggggctggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggggccatcgtgtcctgctacggcaagaccaagtgcaccgccagcaacaagtgccgggggatcatcaagaccttctccaacggctgcgactacgtgagcaacaagggcgtcgacacggtgagcgtggggaacaccctctactacgtcaacaagcaggagggcaagtccctgtacgtgaagggggagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccggcaagtccaccaccaacatcatgatcaccacgatcatcatcgtgatcatcgtcatcctcctgagcctgatcgccgtggggctcctgctgtactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5770 - RNA, 1888 nt, synthetic construct
  misc_feature 1..1888: note = mRNA product Design b-4 comprising derived and/or modified sequence from HRSV(A2)__F-del_DSCav1_mut5 (opt2)
  source 1..1888: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5771 - RNA, 1888 nt, synthetic construct
  misc_feature 1..1888: note = mRNA product Design b-4 comprising derived and/or modified sequence from HRSV(A2)__F-del_DSCav1_mut5 (opt3)
  source 1..1888: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcggttgcggggtgtccgtattaacttttaaggttctggaccttaagaactacattgataaacaattgctgcctatcctaaataagcagtcatgtagtattagcaacatcgagaccgtgatagagttccagcagaaaaataacaggctcctggaaattacacgggagttttctgtcaatgcgggagtgactaccccagtgtccacatatatgcttaccaactcagaactgttgagcctcatcaatgacatgccgattacgaacgatcaaaagaaactgatgagtaacaatgtccagatcgttcgccagcagtcttactccatcatgtgcattataaaggaggaagtgttagcatatgtagtgcaactgcccctctacggcgtcatcgacactccttgttggaaacttcatacaagcccactgtgcaccactaacacaaaggagggctcgaatatttgtttgacccgaacggatcgtgggtggtactgcgacaacgccggatctgtgtccttctttccccaggctgaaacctgtaaggttcagtcaaatagagtgttctgcgatacaatgaacagtagaactctgcctagcgaggtcaatctctgcaacgtggacatctttaatccaaaatatgattgtaagataatgacctccaaaacagacgtatctagctcagttattaccagtctgggtgccatcgtgtcctgctacggcaagactaaatgtacagcaagcaacaagtgcagggggatcattaagaccttctctaatggatgtgattatgtctcaaacaaaggcgtggacactgtcagtgtgggtaatacgctttactatgttaacaagcaagaggggaaaagcctgtacgtgaagggagaacccatcattaatttttatgaccctttggtattcccatccgatgagtttgacgcttctatatcgcaggtcaacgagaaaatcaaccagagcctcgccttcattcggaagtccgatgaactgttacacaatgtgaacgcgggcaagtcaacaaccaatatcatgatcactaccattataatcgttattatcgtgattctgctaagtctcatcgccgtcggcctgcttttgtactgcaaagcacgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5772 - RNA, 1888 nt, synthetic construct
  misc_feature 1..1888: note = mRNA product Design b-4 comprising derived and/or modified sequence from HRSV(A2)__F-del_DSCav1_mut5 (opt4)
  source 1..1888: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5773 - RNA, 1888 nt, synthetic construct
  misc_feature 1..1888: note = mRNA product Design b-4 comprising derived and/or modified sequence from HRSV(A2)__F-del_DSCav1_mut5 (opt5)
  source 1..1888: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcggatgcggcgtttctgtgctgacatttaaggtccttgacctgaagaactacattgataaacaactcctgcctatcctgaataagcagtcctgtagcatttctaacatcgagaccgtgattgagttccagcagaaaaataaccggctcctggaaatcacgcgcgagttttccgtgaatgccggcgtcacaaccccggttagcacatatatgcttaccaactccgaactgctctctctgatcaatgacatgcccattaccaacgatcaaaagaaacttatgagcaacaatgtgcagatcgtgagacagcagtcctacagcattatgtgcatcattaaggaggaagtcctggcttatgtggttcaactccctctgtacggggtgatcgacacaccctgttggaaactgcatacgtctcctctctgcaccacaaacaccaaggagggatccaatatctgtctgacacggaccgatcgcggctggtactgcgacaacgccgggagcgtctctttctttccccaggcggaaacgtgtaaggtgcagagcaatagagttttctgcgatacaatgaactccagaaccctgccttctgaggtgaatctctgcaacgtcgacatttttaatccgaaatatgattgtaagatcatgaccagcaaaacagacgtgtccagctctgtcattacctccctgggagccatcgtgagctgctacggcaagacaaaatgtacggcttctaacaagtgccgggggattatcaagaccttctccaatggatgtgattatgttagcaacaaaggcgtggacacagtctccgtgggcaataccctttactatgttaacaagcaagaggggaaatctctgtacgtgaagggagaacccatcattaatttttatgaccctctcgtcttccccagcgatgagtttgacgcctccatctctcaggtgaacgagaaaattaaccagagcctggctttcatccgcaagtccgatgaactgctccacaatgtgaacgccggcaagagcacaaccaatattatgatcacgaccattatcatcgttattatcgtcattctgctttctctgatcgccgtggggctcctgctgtactgcaaagctagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5774 - RNA, 1888 nt, synthetic construct
  misc_feature 1..1888: note = mRNA product Design b-4 comprising derived and/or modified sequence from HRSV(A2)__F-del_DSCav1_mut5 (opt6)
  source 1..1888: mol_type = other RNA
gggagagtcccgcagtcggcgtccagcggctctgcttgttcgtgtgtgtgtcgttgcaggccttattcaagcttaccatggaacttttaatactgaaagcaaatgccatcacaaccatactaactgccgtcacattctgctttgcatcaggacaaaacataacagaagaattttaccaatccacatgctcagcagtatcaaaaggatatctatcggcacttagaactggatggtacacaagtgttataactatagaactctcaaacataaaagaaaacaaatgcaatggaacagacgcaaaagtaaaactaataaaacaagaactcgataaatataaaaatgcagtaaccgaactacaactattaatgcaaagcacacccgcaacaggcagcggatcagcaatagcaagcggagtcgcagtatgtaaagtactacatctagaaggagaagtcaacaaaatcaaatctgcacttctatccacaaacaaagctgtagtatccctatccggatgcggagtctcagtattaacttttaaagtactagaccttaaaaactacatagataaacaactattaccaatactaaataaacaatcatgcagcatatccaatatagagacagtaattgaatttcaacaaaaaaacaacagattactagaaattactcgtgaattttccgtaaatgccggagtcacaacaccagtatcaacctatatgctaacaaacagcgaactacttagcttaataaatgacatgccaataacaaatgaccaaaaaaaacttatgtcaaataacgtacaaatcgtcagacaacaatcctactctataatgtgtataattaaagaagaagtcctagcatacgtagttcaattaccactctatggagtaatagatacaccatgctggaaactacacacgtcaccactatgtacaacaaacacaaaagaaggatccaatatatgcctaacaagaaccgacagaggctggtattgtgacaacgcaggatccgtttcattcttcccacaagcagaaacctgtaaagtacaatctaatagagtattttgcgacacaatgaacagtagaacactaccaagcgaggttaatctatgtaacgtagacatattcaatccaaaatatgattgcaaaataatgacatcaaaaacagatgtatcgtcgagtgtaataacaagtctgggagctatagtaagctgctacggcaagacgaaatgtaccgcttcaaataaatgcagaggaatcattaaaacattctcgaacggatgcgactacgtaagtaataaaggtgtcgacaccgtatcagtagggaatacattatactacgtcaacaaacaagaaggaaaatctctatatgtaaaaggagaaccaataataaatttctatgaccctctagtattcccatcagatgaatttgacgcttccatatcacaagtaaacgaaaaaatcaatcaatctttagcattcatacgaaaaagtgatgaactcctacacaacgtcaacgcaggaaaaagcacaacaaatataatgatcacaacaatcatcatagtaataatagtaatactactatcattaatagcagtaggattattgctttactgcaaagcacgatagggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5775 - RNA, 1888 nt, synthetic construct
  misc_feature 1..1888: note = mRNA product Design b-4 comprising derived and/or modified sequence from HRSV(A2)__F-del_DSCav1_mut5 (opt11)
  source 1..1888: mol_type = other RNA
gggagagtcccgcagtcggcgtccagcggctctgcttgttcgtgtgtgtgtcgttgcaggccttattcaagcttaccatggaactcctcatcctcaaagccaacgccataaccacaatactcaccgccgtaaccttctgctttgcgtcgggacaaaacatcaccgaagagttctaccaatccacttgctccgcagtaagcaaaggatacctctccgccctgcgaaccggttggtacacatcagtcatcacaatcgaactctcaaacataaaagaaaacaaatgcaacggcaccgacgcaaaggtcaaattaatcaagcaagaactagacaaatacaaaaacgccgtcacagaactccagctgctaatgcagagcacacccgcaactggcagcggatccgccatcgcatcaggagtcgccgtgtgcaaagtcctacacctcgaaggagaagtgaacaaaatcaaatcagccctactctccaccaacaaggccgtcgtctccctctccggctgcggtgtctccgtcctaaccttcaaagtgctagacctcaagaactacatcgacaaacaactcctaccaatactcaacaagcaatcttgctccatctccaacatcgaaaccgtaatcgagttccaacagaagaacaaccgcctcctcgaaatcacccgcgagttctctgtcaacgcaggggtcaccactcccgtctccacatacatgctcacaaactccgaactcctcagcctcatcaacgacatgcccataaccaacgaccagaaaaagctaatgagcaataacgtccaaatcgttagacaacaaagttattccatcatgtgcatcatcaaagaagaagtcctcgcctacgtcgtacaactccccctctatggcgtcatcgacaccccctgctggaaactgcacacatcacccctctgcaccacaaacaccaaagaaggctcaaacatctgcctaactcgcaccgaccgcggctggtactgcgacaacgccggcagcgtatcattctttccccaagccgaaacatgcaaagttcaatccaaccgcgtcttctgcgacacaatgaactccagaacgctccccagcgaagtcaacctctgtaacgtagacatcttcaaccctaagtacgactgcaaaatcatgacctccaaaactgatgtatcctcctccgtcatcacatccctgggcgccatcgtcagctgctacggcaaaacaaaatgcactgcctcaaacaaatgccgaggtatcataaagaccttctcaaacggatgcgattacgtcagcaacaaaggcgtcgacaccgtcagtgtcggcaacaccctctactacgtcaacaaacaagaaggaaaatccctctacgtcaaaggcgaacccatcatcaacttctacgaccccctcgtcttccccagcgacgagttcgacgcctccatctcacaagtcaacgaaaagataaaccaatctctagccttcatccgcaaatccgatgaactcctgcataacgtcaacgccggcaaatccaccacaaacatcatgatcactaccataatcatcgtcataatcgtaatcctcctatctcttatcgcagtcggcctactactctactgcaaagcccgctaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5776 - RNA, 1950 nt, synthetic construct
  misc_feature 1..1950: note = mRNA product Design b-5 comprising derived and/or modified sequence from HRSV(A2)__F-del_DSCav1_mut5 (opt1)
  source 1..1950: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5777 - RNA, 1950 nt, synthetic construct
  misc_feature 1..1950: note = mRNA product Design b-5 comprising derived and/or modified sequence from HRSV(A2)__F-del_DSCav1_mut5 (opt1)
  source 1..1950: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcgggtgcggcgtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggggtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggcgtgatcgacacgccgtgctggaagctgcacaccagccccctctgcaccaccaacacgaaggaggggtccaacatctgcctgacccgcaccgaccggggctggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggggccatcgtgtcctgctacggcaagaccaagtgcaccgccagcaacaagtgccgggggatcatcaagaccttctccaacggctgcgactacgtgagcaacaagggcgtcgacacggtgagcgtggggaacaccctctactacgtcaacaagcaggagggcaagtccctgtacgtgaagggggagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccggcaagtccaccaccaacatcatgatcaccacgatcatcatcgtgatcatcgtcatcctcctgagcctgatcgccgtggggctcctgctgtactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5778 - RNA, 1950 nt, synthetic construct
  misc_feature 1..1950: note = mRNA product Design b-5 comprising derived and/or modified sequence from HRSV(A2)__F-del_DSCav1_mut5 (opt2)
  source 1..1950: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5779 - RNA, 1950 nt, synthetic construct
  misc_feature 1..1950: note = mRNA product Design b-5 comprising derived and/or modified sequence from HRSV(A2)__F-del_DSCav1_mut5 (opt3)
  source 1..1950: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcggttgcggggtgtccgtattaacttttaaggttctggaccttaagaactacattgataaacaattgctgcctatcctaaataagcagtcatgtagtattagcaacatcgagaccgtgatagagttccagcagaaaaataacaggctcctggaaattacacgggagttttctgtcaatgcgggagtgactaccccagtgtccacatatatgcttaccaactcagaactgttgagcctcatcaatgacatgccgattacgaacgatcaaaagaaactgatgagtaacaatgtccagatcgttcgccagcagtcttactccatcatgtgcattataaaggaggaagtgttagcatatgtagtgcaactgcccctctacggcgtcatcgacactccttgttggaaacttcatacaagcccactgtgcaccactaacacaaaggagggctcgaatatttgtttgacccgaacggatcgtgggtggtactgcgacaacgccggatctgtgtccttctttccccaggctgaaacctgtaaggttcagtcaaatagagtgttctgcgatacaatgaacagtagaactctgcctagcgaggtcaatctctgcaacgtggacatctttaatccaaaatatgattgtaagataatgacctccaaaacagacgtatctagctcagttattaccagtctgggtgccatcgtgtcctgctacggcaagactaaatgtacagcaagcaacaagtgcagggggatcattaagaccttctctaatggatgtgattatgtctcaaacaaaggcgtggacactgtcagtgtgggtaatacgctttactatgttaacaagcaagaggggaaaagcctgtacgtgaagggagaacccatcattaatttttatgaccctttggtattcccatccgatgagtttgacgcttctatatcgcaggtcaacgagaaaatcaaccagagcctcgccttcattcggaagtccgatgaactgttacacaatgtgaacgcgggcaagtcaacaaccaatatcatgatcactaccattataatcgttattatcgtgattctgctaagtctcatcgccgtcggcctgcttttgtactgcaaagcacgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5780 - RNA, 1950 nt, synthetic construct
  misc_feature 1..1950: note = mRNA product Design b-5 comprising derived and/or modified sequence from HRSV(A2)__F-del_DSCav1_mut5 (opt4)
  source 1..1950: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5781 - RNA, 1950 nt, synthetic construct
  misc_feature 1..1950: note = mRNA product Design b-5 comprising derived and/or modified sequence from HRSV(A2)__F-del_DSCav1_mut5 (opt5)
  source 1..1950: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcggatgcggcgtttctgtgctgacatttaaggtccttgacctgaagaactacattgataaacaactcctgcctatcctgaataagcagtcctgtagcatttctaacatcgagaccgtgattgagttccagcagaaaaataaccggctcctggaaatcacgcgcgagttttccgtgaatgccggcgtcacaaccccggttagcacatatatgcttaccaactccgaactgctctctctgatcaatgacatgcccattaccaacgatcaaaagaaacttatgagcaacaatgtgcagatcgtgagacagcagtcctacagcattatgtgcatcattaaggaggaagtcctggcttatgtggttcaactccctctgtacggggtgatcgacacaccctgttggaaactgcatacgtctcctctctgcaccacaaacaccaaggagggatccaatatctgtctgacacggaccgatcgcggctggtactgcgacaacgccgggagcgtctctttctttccccaggcggaaacgtgtaaggtgcagagcaatagagttttctgcgatacaatgaactccagaaccctgccttctgaggtgaatctctgcaacgtcgacatttttaatccgaaatatgattgtaagatcatgaccagcaaaacagacgtgtccagctctgtcattacctccctgggagccatcgtgagctgctacggcaagacaaaatgtacggcttctaacaagtgccgggggattatcaagaccttctccaatggatgtgattatgttagcaacaaaggcgtggacacagtctccgtgggcaataccctttactatgttaacaagcaagaggggaaatctctgtacgtgaagggagaacccatcattaatttttatgaccctctcgtcttccccagcgatgagtttgacgcctccatctctcaggtgaacgagaaaattaaccagagcctggctttcatccgcaagtccgatgaactgctccacaatgtgaacgccggcaagagcacaaccaatattatgatcacgaccattatcatcgttattatcgtcattctgctttctctgatcgccgtggggctcctgctgtactgcaaagctagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5782 - RNA, 1950 nt, synthetic construct
  misc_feature 1..1950: note = mRNA product Design b-5 comprising derived and/or modified sequence from HRSV(A2)__F-del_DSCav1_mut5 (opt6)
  source 1..1950: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaacttttaatactgaaagcaaatgccatcacaaccatactaactgccgtcacattctgctttgcatcaggacaaaacataacagaagaattttaccaatccacatgctcagcagtatcaaaaggatatctatcggcacttagaactggatggtacacaagtgttataactatagaactctcaaacataaaagaaaacaaatgcaatggaacagacgcaaaagtaaaactaataaaacaagaactcgataaatataaaaatgcagtaaccgaactacaactattaatgcaaagcacacccgcaacaggcagcggatcagcaatagcaagcggagtcgcagtatgtaaagtactacatctagaaggagaagtcaacaaaatcaaatctgcacttctatccacaaacaaagctgtagtatccctatccggatgcggagtctcagtattaacttttaaagtactagaccttaaaaactacatagataaacaactattaccaatactaaataaacaatcatgcagcatatccaatatagagacagtaattgaatttcaacaaaaaaacaacagattactagaaattactcgtgaattttccgtaaatgccggagtcacaacaccagtatcaacctatatgctaacaaacagcgaactacttagcttaataaatgacatgccaataacaaatgaccaaaaaaaacttatgtcaaataacgtacaaatcgtcagacaacaatcctactctataatgtgtataattaaagaagaagtcctagcatacgtagttcaattaccactctatggagtaatagatacaccatgctggaaactacacacgtcaccactatgtacaacaaacacaaaagaaggatccaatatatgcctaacaagaaccgacagaggctggtattgtgacaacgcaggatccgtttcattcttcccacaagcagaaacctgtaaagtacaatctaatagagtattttgcgacacaatgaacagtagaacactaccaagcgaggttaatctatgtaacgtagacatattcaatccaaaatatgattgcaaaataatgacatcaaaaacagatgtatcgtcgagtgtaataacaagtctgggagctatagtaagctgctacggcaagacgaaatgtaccgcttcaaataaatgcagaggaatcattaaaacattctcgaacggatgcgactacgtaagtaataaaggtgtcgacaccgtatcagtagggaatacattatactacgtcaacaaacaagaaggaaaatctctatatgtaaaaggagaaccaataataaatttctatgaccctctagtattcccatcagatgaatttgacgcttccatatcacaagtaaacgaaaaaatcaatcaatctttagcattcatacgaaaaagtgatgaactcctacacaacgtcaacgcaggaaaaagcacaacaaatataatgatcacaacaatcatcatagtaataatagtaatactactatcattaatagcagtaggattattgctttactgcaaagcacgatagggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5783 - RNA, 1950 nt, synthetic construct
  misc_feature 1..1950: note = mRNA product Design b-5 comprising derived and/or modified sequence from HRSV(A2)__F-del_DSCav1_mut5 (opt11)
  source 1..1950: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactcctcatcctcaaagccaacgccataaccacaatactcaccgccgtaaccttctgctttgcgtcgggacaaaacatcaccgaagagttctaccaatccacttgctccgcagtaagcaaaggatacctctccgccctgcgaaccggttggtacacatcagtcatcacaatcgaactctcaaacataaaagaaaacaaatgcaacggcaccgacgcaaaggtcaaattaatcaagcaagaactagacaaatacaaaaacgccgtcacagaactccagctgctaatgcagagcacacccgcaactggcagcggatccgccatcgcatcaggagtcgccgtgtgcaaagtcctacacctcgaaggagaagtgaacaaaatcaaatcagccctactctccaccaacaaggccgtcgtctccctctccggctgcggtgtctccgtcctaaccttcaaagtgctagacctcaagaactacatcgacaaacaactcctaccaatactcaacaagcaatcttgctccatctccaacatcgaaaccgtaatcgagttccaacagaagaacaaccgcctcctcgaaatcacccgcgagttctctgtcaacgcaggggtcaccactcccgtctccacatacatgctcacaaactccgaactcctcagcctcatcaacgacatgcccataaccaacgaccagaaaaagctaatgagcaataacgtccaaatcgttagacaacaaagttattccatcatgtgcatcatcaaagaagaagtcctcgcctacgtcgtacaactccccctctatggcgtcatcgacaccccctgctggaaactgcacacatcacccctctgcaccacaaacaccaaagaaggctcaaacatctgcctaactcgcaccgaccgcggctggtactgcgacaacgccggcagcgtatcattctttccccaagccgaaacatgcaaagttcaatccaaccgcgtcttctgcgacacaatgaactccagaacgctccccagcgaagtcaacctctgtaacgtagacatcttcaaccctaagtacgactgcaaaatcatgacctccaaaactgatgtatcctcctccgtcatcacatccctgggcgccatcgtcagctgctacggcaaaacaaaatgcactgcctcaaacaaatgccgaggtatcataaagaccttctcaaacggatgcgattacgtcagcaacaaaggcgtcgacaccgtcagtgtcggcaacaccctctactacgtcaacaaacaagaaggaaaatccctctacgtcaaaggcgaacccatcatcaacttctacgaccccctcgtcttccccagcgacgagttcgacgcctccatctcacaagtcaacgaaaagataaaccaatctctagccttcatccgcaaatccgatgaactcctgcataacgtcaacgccggcaaatccaccacaaacatcatgatcactaccataatcatcgtcataatcgtaatcctcctatctcttatcgcagtcggcctactactctactgcaaagcccgctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5784 - RNA, 1856 nt, synthetic construct
  misc_feature 1..1856: note = mRNA product Design c-1 comprising derived and/or modified sequence from HRSV(A2)__F-del_DSCav1_mut5 (opt1)
  source 1..1856: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5785 - RNA, 1856 nt, synthetic construct
  misc_feature 1..1856: note = mRNA product Design c-1 comprising derived and/or modified sequence from HRSV(A2)__F-del_DSCav1_mut5 (opt1)
  source 1..1856: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcgggtgcggcgtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggggtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggcgtgatcgacacgccgtgctggaagctgcacaccagccccctctgcaccaccaacacgaaggaggggtccaacatctgcctgacccgcaccgaccggggctggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggggccatcgtgtcctgctacggcaagaccaagtgcaccgccagcaacaagtgccgggggatcatcaagaccttctccaacggctgcgactacgtgagcaacaagggcgtcgacacggtgagcgtggggaacaccctctactacgtcaacaagcaggagggcaagtccctgtacgtgaagggggagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccggcaagtccaccaccaacatcatgatcaccacgatcatcatcgtgatcatcgtcatcctcctgagcctgatcgccgtggggctcctgctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5786 - RNA, 1856 nt, synthetic construct
  misc_feature 1..1856: note = mRNA product Design c-1 comprising derived and/or modified sequence from HRSV(A2)__F-del_DSCav1_mut5 (opt2)
  source 1..1856: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5787 - RNA, 1856 nt, synthetic construct
  misc_feature 1..1856: note = mRNA product Design c-1 comprising derived and/or modified sequence from HRSV(A2)__F-del_DSCav1_mut5 (opt3)
  source 1..1856: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcggttgcggggtgtccgtattaacttttaaggttctggaccttaagaactacattgataaacaattgctgcctatcctaaataagcagtcatgtagtattagcaacatcgagaccgtgatagagttccagcagaaaaataacaggctcctggaaattacacgggagttttctgtcaatgcgggagtgactaccccagtgtccacatatatgcttaccaactcagaactgttgagcctcatcaatgacatgccgattacgaacgatcaaaagaaactgatgagtaacaatgtccagatcgttcgccagcagtcttactccatcatgtgcattataaaggaggaagtgttagcatatgtagtgcaactgcccctctacggcgtcatcgacactccttgttggaaacttcatacaagcccactgtgcaccactaacacaaaggagggctcgaatatttgtttgacccgaacggatcgtgggtggtactgcgacaacgccggatctgtgtccttctttccccaggctgaaacctgtaaggttcagtcaaatagagtgttctgcgatacaatgaacagtagaactctgcctagcgaggtcaatctctgcaacgtggacatctttaatccaaaatatgattgtaagataatgacctccaaaacagacgtatctagctcagttattaccagtctgggtgccatcgtgtcctgctacggcaagactaaatgtacagcaagcaacaagtgcagggggatcattaagaccttctctaatggatgtgattatgtctcaaacaaaggcgtggacactgtcagtgtgggtaatacgctttactatgttaacaagcaagaggggaaaagcctgtacgtgaagggagaacccatcattaatttttatgaccctttggtattcccatccgatgagtttgacgcttctatatcgcaggtcaacgagaaaatcaaccagagcctcgccttcattcggaagtccgatgaactgttacacaatgtgaacgcgggcaagtcaacaaccaatatcatgatcactaccattataatcgttattatcgtgattctgctaagtctcatcgccgtcggcctgcttttgtactgcaaagcacgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5788 - RNA, 1856 nt, synthetic construct
  misc_feature 1..1856: note = mRNA product Design c-1 comprising derived and/or modified sequence from HRSV(A2)__F-del_DSCav1_mut5 (opt4)
  source 1..1856: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5789 - RNA, 1856 nt, synthetic construct
  misc_feature 1..1856: note = mRNA product Design c-1 comprising derived and/or modified sequence from HRSV(A2)__F-del_DSCav1_mut5 (opt5)
  source 1..1856: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcggatgcggcgtttctgtgctgacatttaaggtccttgacctgaagaactacattgataaacaactcctgcctatcctgaataagcagtcctgtagcatttctaacatcgagaccgtgattgagttccagcagaaaaataaccggctcctggaaatcacgcgcgagttttccgtgaatgccggcgtcacaaccccggttagcacatatatgcttaccaactccgaactgctctctctgatcaatgacatgcccattaccaacgatcaaaagaaacttatgagcaacaatgtgcagatcgtgagacagcagtcctacagcattatgtgcatcattaaggaggaagtcctggcttatgtggttcaactccctctgtacggggtgatcgacacaccctgttggaaactgcatacgtctcctctctgcaccacaaacaccaaggagggatccaatatctgtctgacacggaccgatcgcggctggtactgcgacaacgccgggagcgtctctttctttccccaggcggaaacgtgtaaggtgcagagcaatagagttttctgcgatacaatgaactccagaaccctgccttctgaggtgaatctctgcaacgtcgacatttttaatccgaaatatgattgtaagatcatgaccagcaaaacagacgtgtccagctctgtcattacctccctgggagccatcgtgagctgctacggcaagacaaaatgtacggcttctaacaagtgccgggggattatcaagaccttctccaatggatgtgattatgttagcaacaaaggcgtggacacagtctccgtgggcaataccctttactatgttaacaagcaagaggggaaatctctgtacgtgaagggagaacccatcattaatttttatgaccctctcgtcttccccagcgatgagtttgacgcctccatctctcaggtgaacgagaaaattaaccagagcctggctttcatccgcaagtccgatgaactgctccacaatgtgaacgccggcaagagcacaaccaatattatgatcacgaccattatcatcgttattatcgtcattctgctttctctgatcgccgtggggctcctgctgtactgcaaagctagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5790 - RNA, 1856 nt, synthetic construct
  misc_feature 1..1856: note = mRNA product Design c-1 comprising derived and/or modified sequence from HRSV(A2)__F-del_DSCav1_mut5 (opt6)
  source 1..1856: mol_type = other RNA
gggagagtccgctcagccaggttgcagaagcggcttagcgtgtgtcctaatcttctctctgcgtgtaggtaggcctgtgccgcaaacaagcttaccatggaacttttaatactgaaagcaaatgccatcacaaccatactaactgccgtcacattctgctttgcatcaggacaaaacataacagaagaattttaccaatccacatgctcagcagtatcaaaaggatatctatcggcacttagaactggatggtacacaagtgttataactatagaactctcaaacataaaagaaaacaaatgcaatggaacagacgcaaaagtaaaactaataaaacaagaactcgataaatataaaaatgcagtaaccgaactacaactattaatgcaaagcacacccgcaacaggcagcggatcagcaatagcaagcggagtcgcagtatgtaaagtactacatctagaaggagaagtcaacaaaatcaaatctgcacttctatccacaaacaaagctgtagtatccctatccggatgcggagtctcagtattaacttttaaagtactagaccttaaaaactacatagataaacaactattaccaatactaaataaacaatcatgcagcatatccaatatagagacagtaattgaatttcaacaaaaaaacaacagattactagaaattactcgtgaattttccgtaaatgccggagtcacaacaccagtatcaacctatatgctaacaaacagcgaactacttagcttaataaatgacatgccaataacaaatgaccaaaaaaaacttatgtcaaataacgtacaaatcgtcagacaacaatcctactctataatgtgtataattaaagaagaagtcctagcatacgtagttcaattaccactctatggagtaatagatacaccatgctggaaactacacacgtcaccactatgtacaacaaacacaaaagaaggatccaatatatgcctaacaagaaccgacagaggctggtattgtgacaacgcaggatccgtttcattcttcccacaagcagaaacctgtaaagtacaatctaatagagtattttgcgacacaatgaacagtagaacactaccaagcgaggttaatctatgtaacgtagacatattcaatccaaaatatgattgcaaaataatgacatcaaaaacagatgtatcgtcgagtgtaataacaagtctgggagctatagtaagctgctacggcaagacgaaatgtaccgcttcaaataaatgcagaggaatcattaaaacattctcgaacggatgcgactacgtaagtaataaaggtgtcgacaccgtatcagtagggaatacattatactacgtcaacaaacaagaaggaaaatctctatatgtaaaaggagaaccaataataaatttctatgaccctctagtattcccatcagatgaatttgacgcttccatatcacaagtaaacgaaaaaatcaatcaatctttagcattcatacgaaaaagtgatgaactcctacacaacgtcaacgcaggaaaaagcacaacaaatataatgatcacaacaatcatcatagtaataatagtaatactactatcattaatagcagtaggattattgctttactgcaaagcacgatagggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5791 - RNA, 1856 nt, synthetic construct
  misc_feature 1..1856: note = mRNA product Design c-1 comprising derived and/or modified sequence from HRSV(A2)__F-del_DSCav1_mut5 (opt11)
  source 1..1856: mol_type = other RNA
gggagagtccgctcagccaggttgcagaagcggcttagcgtgtgtcctaatcttctctctgcgtgtaggtaggcctgtgccgcaaacaagcttaccatggaactcctcatcctcaaagccaacgccataaccacaatactcaccgccgtaaccttctgctttgcgtcgggacaaaacatcaccgaagagttctaccaatccacttgctccgcagtaagcaaaggatacctctccgccctgcgaaccggttggtacacatcagtcatcacaatcgaactctcaaacataaaagaaaacaaatgcaacggcaccgacgcaaaggtcaaattaatcaagcaagaactagacaaatacaaaaacgccgtcacagaactccagctgctaatgcagagcacacccgcaactggcagcggatccgccatcgcatcaggagtcgccgtgtgcaaagtcctacacctcgaaggagaagtgaacaaaatcaaatcagccctactctccaccaacaaggccgtcgtctccctctccggctgcggtgtctccgtcctaaccttcaaagtgctagacctcaagaactacatcgacaaacaactcctaccaatactcaacaagcaatcttgctccatctccaacatcgaaaccgtaatcgagttccaacagaagaacaaccgcctcctcgaaatcacccgcgagttctctgtcaacgcaggggtcaccactcccgtctccacatacatgctcacaaactccgaactcctcagcctcatcaacgacatgcccataaccaacgaccagaaaaagctaatgagcaataacgtccaaatcgttagacaacaaagttattccatcatgtgcatcatcaaagaagaagtcctcgcctacgtcgtacaactccccctctatggcgtcatcgacaccccctgctggaaactgcacacatcacccctctgcaccacaaacaccaaagaaggctcaaacatctgcctaactcgcaccgaccgcggctggtactgcgacaacgccggcagcgtatcattctttccccaagccgaaacatgcaaagttcaatccaaccgcgtcttctgcgacacaatgaactccagaacgctccccagcgaagtcaacctctgtaacgtagacatcttcaaccctaagtacgactgcaaaatcatgacctccaaaactgatgtatcctcctccgtcatcacatccctgggcgccatcgtcagctgctacggcaaaacaaaatgcactgcctcaaacaaatgccgaggtatcataaagaccttctcaaacggatgcgattacgtcagcaacaaaggcgtcgacaccgtcagtgtcggcaacaccctctactacgtcaacaaacaagaaggaaaatccctctacgtcaaaggcgaacccatcatcaacttctacgaccccctcgtcttccccagcgacgagttcgacgcctccatctcacaagtcaacgaaaagataaaccaatctctagccttcatccgcaaatccgatgaactcctgcataacgtcaacgccggcaaatccaccacaaacatcatgatcactaccataatcatcgtcataatcgtaatcctcctatctcttatcgcagtcggcctactactctactgcaaagcccgctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5792 - RNA, 1946 nt, synthetic construct
  misc_feature 1..1946: note = mRNA product Design c-2 comprising derived and/or modified sequence from HRSV(A2)__F-del_DSCav1_mut5 (opt1)
  source 1..1946: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5793 - RNA, 1946 nt, synthetic construct
  misc_feature 1..1946: note = mRNA product Design c-2 comprising derived and/or modified sequence from HRSV(A2)__F-del_DSCav1_mut5 (opt1)
  source 1..1946: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcgggtgcggcgtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggggtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggcgtgatcgacacgccgtgctggaagctgcacaccagccccctctgcaccaccaacacgaaggaggggtccaacatctgcctgacccgcaccgaccggggctggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggggccatcgtgtcctgctacggcaagaccaagtgcaccgccagcaacaagtgccgggggatcatcaagaccttctccaacggctgcgactacgtgagcaacaagggcgtcgacacggtgagcgtggggaacaccctctactacgtcaacaagcaggagggcaagtccctgtacgtgaagggggagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccggcaagtccaccaccaacatcatgatcaccacgatcatcatcgtgatcatcgtcatcctcctgagcctgatcgccgtggggctcctgctgtactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5794 - RNA, 1946 nt, synthetic construct
  misc_feature 1..1946: note = mRNA product Design c-2 comprising derived and/or modified sequence from HRSV(A2)__F-del_DSCav1_mut5 (opt2)
  source 1..1946: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5795 - RNA, 1946 nt, synthetic construct
  misc_feature 1..1946: note = mRNA product Design c-2 comprising derived and/or modified sequence from HRSV(A2)__F-del_DSCav1_mut5 (opt3)
  source 1..1946: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcggttgcggggtgtccgtattaacttttaaggttctggaccttaagaactacattgataaacaattgctgcctatcctaaataagcagtcatgtagtattagcaacatcgagaccgtgatagagttccagcagaaaaataacaggctcctggaaattacacgggagttttctgtcaatgcgggagtgactaccccagtgtccacatatatgcttaccaactcagaactgttgagcctcatcaatgacatgccgattacgaacgatcaaaagaaactgatgagtaacaatgtccagatcgttcgccagcagtcttactccatcatgtgcattataaaggaggaagtgttagcatatgtagtgcaactgcccctctacggcgtcatcgacactccttgttggaaacttcatacaagcccactgtgcaccactaacacaaaggagggctcgaatatttgtttgacccgaacggatcgtgggtggtactgcgacaacgccggatctgtgtccttctttccccaggctgaaacctgtaaggttcagtcaaatagagtgttctgcgatacaatgaacagtagaactctgcctagcgaggtcaatctctgcaacgtggacatctttaatccaaaatatgattgtaagataatgacctccaaaacagacgtatctagctcagttattaccagtctgggtgccatcgtgtcctgctacggcaagactaaatgtacagcaagcaacaagtgcagggggatcattaagaccttctctaatggatgtgattatgtctcaaacaaaggcgtggacactgtcagtgtgggtaatacgctttactatgttaacaagcaagaggggaaaagcctgtacgtgaagggagaacccatcattaatttttatgaccctttggtattcccatccgatgagtttgacgcttctatatcgcaggtcaacgagaaaatcaaccagagcctcgccttcattcggaagtccgatgaactgttacacaatgtgaacgcgggcaagtcaacaaccaatatcatgatcactaccattataatcgttattatcgtgattctgctaagtctcatcgccgtcggcctgcttttgtactgcaaagcacgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5796 - RNA, 1946 nt, synthetic construct
  misc_feature 1..1946: note = mRNA product Design c-2 comprising derived and/or modified sequence from HRSV(A2)__F-del_DSCav1_mut5 (opt4)
  source 1..1946: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5797 - RNA, 1946 nt, synthetic construct
  misc_feature 1..1946: note = mRNA product Design c-2 comprising derived and/or modified sequence from HRSV(A2)__F-del_DSCav1_mut5 (opt5)
  source 1..1946: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcggatgcggcgtttctgtgctgacatttaaggtccttgacctgaagaactacattgataaacaactcctgcctatcctgaataagcagtcctgtagcatttctaacatcgagaccgtgattgagttccagcagaaaaataaccggctcctggaaatcacgcgcgagttttccgtgaatgccggcgtcacaaccccggttagcacatatatgcttaccaactccgaactgctctctctgatcaatgacatgcccattaccaacgatcaaaagaaacttatgagcaacaatgtgcagatcgtgagacagcagtcctacagcattatgtgcatcattaaggaggaagtcctggcttatgtggttcaactccctctgtacggggtgatcgacacaccctgttggaaactgcatacgtctcctctctgcaccacaaacaccaaggagggatccaatatctgtctgacacggaccgatcgcggctggtactgcgacaacgccgggagcgtctctttctttccccaggcggaaacgtgtaaggtgcagagcaatagagttttctgcgatacaatgaactccagaaccctgccttctgaggtgaatctctgcaacgtcgacatttttaatccgaaatatgattgtaagatcatgaccagcaaaacagacgtgtccagctctgtcattacctccctgggagccatcgtgagctgctacggcaagacaaaatgtacggcttctaacaagtgccgggggattatcaagaccttctccaatggatgtgattatgttagcaacaaaggcgtggacacagtctccgtgggcaataccctttactatgttaacaagcaagaggggaaatctctgtacgtgaagggagaacccatcattaatttttatgaccctctcgtcttccccagcgatgagtttgacgcctccatctctcaggtgaacgagaaaattaaccagagcctggctttcatccgcaagtccgatgaactgctccacaatgtgaacgccggcaagagcacaaccaatattatgatcacgaccattatcatcgttattatcgtcattctgctttctctgatcgccgtggggctcctgctgtactgcaaagctagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5798 - RNA, 1946 nt, synthetic construct
  misc_feature 1..1946: note = mRNA product Design c-2 comprising derived and/or modified sequence from HRSV(A2)__F-del_DSCav1_mut5 (opt6)
  source 1..1946: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaacttttaatactgaaagcaaatgccatcacaaccatactaactgccgtcacattctgctttgcatcaggacaaaacataacagaagaattttaccaatccacatgctcagcagtatcaaaaggatatctatcggcacttagaactggatggtacacaagtgttataactatagaactctcaaacataaaagaaaacaaatgcaatggaacagacgcaaaagtaaaactaataaaacaagaactcgataaatataaaaatgcagtaaccgaactacaactattaatgcaaagcacacccgcaacaggcagcggatcagcaatagcaagcggagtcgcagtatgtaaagtactacatctagaaggagaagtcaacaaaatcaaatctgcacttctatccacaaacaaagctgtagtatccctatccggatgcggagtctcagtattaacttttaaagtactagaccttaaaaactacatagataaacaactattaccaatactaaataaacaatcatgcagcatatccaatatagagacagtaattgaatttcaacaaaaaaacaacagattactagaaattactcgtgaattttccgtaaatgccggagtcacaacaccagtatcaacctatatgctaacaaacagcgaactacttagcttaataaatgacatgccaataacaaatgaccaaaaaaaacttatgtcaaataacgtacaaatcgtcagacaacaatcctactctataatgtgtataattaaagaagaagtcctagcatacgtagttcaattaccactctatggagtaatagatacaccatgctggaaactacacacgtcaccactatgtacaacaaacacaaaagaaggatccaatatatgcctaacaagaaccgacagaggctggtattgtgacaacgcaggatccgtttcattcttcccacaagcagaaacctgtaaagtacaatctaatagagtattttgcgacacaatgaacagtagaacactaccaagcgaggttaatctatgtaacgtagacatattcaatccaaaatatgattgcaaaataatgacatcaaaaacagatgtatcgtcgagtgtaataacaagtctgggagctatagtaagctgctacggcaagacgaaatgtaccgcttcaaataaatgcagaggaatcattaaaacattctcgaacggatgcgactacgtaagtaataaaggtgtcgacaccgtatcagtagggaatacattatactacgtcaacaaacaagaaggaaaatctctatatgtaaaaggagaaccaataataaatttctatgaccctctagtattcccatcagatgaatttgacgcttccatatcacaagtaaacgaaaaaatcaatcaatctttagcattcatacgaaaaagtgatgaactcctacacaacgtcaacgcaggaaaaagcacaacaaatataatgatcacaacaatcatcatagtaataatagtaatactactatcattaatagcagtaggattattgctttactgcaaagcacgatagggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5799 - RNA, 1946 nt, synthetic construct
  misc_feature 1..1946: note = mRNA product Design c-2 comprising derived and/or modified sequence from HRSV(A2)__F-del_DSCav1_mut5 (opt11)
  source 1..1946: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactcctcatcctcaaagccaacgccataaccacaatactcaccgccgtaaccttctgctttgcgtcgggacaaaacatcaccgaagagttctaccaatccacttgctccgcagtaagcaaaggatacctctccgccctgcgaaccggttggtacacatcagtcatcacaatcgaactctcaaacataaaagaaaacaaatgcaacggcaccgacgcaaaggtcaaattaatcaagcaagaactagacaaatacaaaaacgccgtcacagaactccagctgctaatgcagagcacacccgcaactggcagcggatccgccatcgcatcaggagtcgccgtgtgcaaagtcctacacctcgaaggagaagtgaacaaaatcaaatcagccctactctccaccaacaaggccgtcgtctccctctccggctgcggtgtctccgtcctaaccttcaaagtgctagacctcaagaactacatcgacaaacaactcctaccaatactcaacaagcaatcttgctccatctccaacatcgaaaccgtaatcgagttccaacagaagaacaaccgcctcctcgaaatcacccgcgagttctctgtcaacgcaggggtcaccactcccgtctccacatacatgctcacaaactccgaactcctcagcctcatcaacgacatgcccataaccaacgaccagaaaaagctaatgagcaataacgtccaaatcgttagacaacaaagttattccatcatgtgcatcatcaaagaagaagtcctcgcctacgtcgtacaactccccctctatggcgtcatcgacaccccctgctggaaactgcacacatcacccctctgcaccacaaacaccaaagaaggctcaaacatctgcctaactcgcaccgaccgcggctggtactgcgacaacgccggcagcgtatcattctttccccaagccgaaacatgcaaagttcaatccaaccgcgtcttctgcgacacaatgaactccagaacgctccccagcgaagtcaacctctgtaacgtagacatcttcaaccctaagtacgactgcaaaatcatgacctccaaaactgatgtatcctcctccgtcatcacatccctgggcgccatcgtcagctgctacggcaaaacaaaatgcactgcctcaaacaaatgccgaggtatcataaagaccttctcaaacggatgcgattacgtcagcaacaaaggcgtcgacaccgtcagtgtcggcaacaccctctactacgtcaacaaacaagaaggaaaatccctctacgtcaaaggcgaacccatcatcaacttctacgaccccctcgtcttccccagcgacgagttcgacgcctccatctcacaagtcaacgaaaagataaaccaatctctagccttcatccgcaaatccgatgaactcctgcataacgtcaacgccggcaaatccaccacaaacatcatgatcactaccataatcatcgtcataatcgtaatcctcctatctcttatcgcagtcggcctactactctactgcaaagcccgctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5800 - RNA, 1923 nt, synthetic construct
  misc_feature 1..1923: note = mRNA product Design c-3 comprising derived and/or modified sequence from HRSV(A2)__F-del_DSCav1_mut5 (opt1)
  source 1..1923: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5801 - RNA, 1923 nt, synthetic construct
  misc_feature 1..1923: note = mRNA product Design c-3 comprising derived and/or modified sequence from HRSV(A2)__F-del_DSCav1_mut5 (opt1)
  source 1..1923: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcgggtgcggcgtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggggtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggcgtgatcgacacgccgtgctggaagctgcacaccagccccctctgcaccaccaacacgaaggaggggtccaacatctgcctgacccgcaccgaccggggctggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggggccatcgtgtcctgctacggcaagaccaagtgcaccgccagcaacaagtgccgggggatcatcaagaccttctccaacggctgcgactacgtgagcaacaagggcgtcgacacggtgagcgtggggaacaccctctactacgtcaacaagcaggagggcaagtccctgtacgtgaagggggagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccggcaagtccaccaccaacatcatgatcaccacgatcatcatcgtgatcatcgtcatcctcctgagcctgatcgccgtggggctcctgctgtactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5802 - RNA, 1923 nt, synthetic construct
  misc_feature 1..1923: note = mRNA product Design c-3 comprising derived and/or modified sequence from HRSV(A2)__F-del_DSCav1_mut5 (opt2)
  source 1..1923: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5803 - RNA, 1923 nt, synthetic construct
  misc_feature 1..1923: note = mRNA product Design c-3 comprising derived and/or modified sequence from HRSV(A2)__F-del_DSCav1_mut5 (opt3)
  source 1..1923: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcggttgcggggtgtccgtattaacttttaaggttctggaccttaagaactacattgataaacaattgctgcctatcctaaataagcagtcatgtagtattagcaacatcgagaccgtgatagagttccagcagaaaaataacaggctcctggaaattacacgggagttttctgtcaatgcgggagtgactaccccagtgtccacatatatgcttaccaactcagaactgttgagcctcatcaatgacatgccgattacgaacgatcaaaagaaactgatgagtaacaatgtccagatcgttcgccagcagtcttactccatcatgtgcattataaaggaggaagtgttagcatatgtagtgcaactgcccctctacggcgtcatcgacactccttgttggaaacttcatacaagcccactgtgcaccactaacacaaaggagggctcgaatatttgtttgacccgaacggatcgtgggtggtactgcgacaacgccggatctgtgtccttctttccccaggctgaaacctgtaaggttcagtcaaatagagtgttctgcgatacaatgaacagtagaactctgcctagcgaggtcaatctctgcaacgtggacatctttaatccaaaatatgattgtaagataatgacctccaaaacagacgtatctagctcagttattaccagtctgggtgccatcgtgtcctgctacggcaagactaaatgtacagcaagcaacaagtgcagggggatcattaagaccttctctaatggatgtgattatgtctcaaacaaaggcgtggacactgtcagtgtgggtaatacgctttactatgttaacaagcaagaggggaaaagcctgtacgtgaagggagaacccatcattaatttttatgaccctttggtattcccatccgatgagtttgacgcttctatatcgcaggtcaacgagaaaatcaaccagagcctcgccttcattcggaagtccgatgaactgttacacaatgtgaacgcgggcaagtcaacaaccaatatcatgatcactaccattataatcgttattatcgtgattctgctaagtctcatcgccgtcggcctgcttttgtactgcaaagcacgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5804 - RNA, 1923 nt, synthetic construct
  misc_feature 1..1923: note = mRNA product Design c-3 comprising derived and/or modified sequence from HRSV(A2)__F-del_DSCav1_mut5 (opt4)
  source 1..1923: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5805 - RNA, 1923 nt, synthetic construct
  misc_feature 1..1923: note = mRNA product Design c-3 comprising derived and/or modified sequence from HRSV(A2)__F-del_DSCav1_mut5 (opt5)
  source 1..1923: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcggatgcggcgtttctgtgctgacatttaaggtccttgacctgaagaactacattgataaacaactcctgcctatcctgaataagcagtcctgtagcatttctaacatcgagaccgtgattgagttccagcagaaaaataaccggctcctggaaatcacgcgcgagttttccgtgaatgccggcgtcacaaccccggttagcacatatatgcttaccaactccgaactgctctctctgatcaatgacatgcccattaccaacgatcaaaagaaacttatgagcaacaatgtgcagatcgtgagacagcagtcctacagcattatgtgcatcattaaggaggaagtcctggcttatgtggttcaactccctctgtacggggtgatcgacacaccctgttggaaactgcatacgtctcctctctgcaccacaaacaccaaggagggatccaatatctgtctgacacggaccgatcgcggctggtactgcgacaacgccgggagcgtctctttctttccccaggcggaaacgtgtaaggtgcagagcaatagagttttctgcgatacaatgaactccagaaccctgccttctgaggtgaatctctgcaacgtcgacatttttaatccgaaatatgattgtaagatcatgaccagcaaaacagacgtgtccagctctgtcattacctccctgggagccatcgtgagctgctacggcaagacaaaatgtacggcttctaacaagtgccgggggattatcaagaccttctccaatggatgtgattatgttagcaacaaaggcgtggacacagtctccgtgggcaataccctttactatgttaacaagcaagaggggaaatctctgtacgtgaagggagaacccatcattaatttttatgaccctctcgtcttccccagcgatgagtttgacgcctccatctctcaggtgaacgagaaaattaaccagagcctggctttcatccgcaagtccgatgaactgctccacaatgtgaacgccggcaagagcacaaccaatattatgatcacgaccattatcatcgttattatcgtcattctgctttctctgatcgccgtggggctcctgctgtactgcaaagctagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5806 - RNA, 1923 nt, synthetic construct
  misc_feature 1..1923: note = mRNA product Design c-3 comprising derived and/or modified sequence from HRSV(A2)__F-del_DSCav1_mut5 (opt6)
  source 1..1923: mol_type = other RNA
gggagagtccgctcagccaggttgcagaagcggcttagcgtgtgtcctaatcttctctctgcgtgtaggtaggcctgtgccgcaaacaagcttaccatggaacttttaatactgaaagcaaatgccatcacaaccatactaactgccgtcacattctgctttgcatcaggacaaaacataacagaagaattttaccaatccacatgctcagcagtatcaaaaggatatctatcggcacttagaactggatggtacacaagtgttataactatagaactctcaaacataaaagaaaacaaatgcaatggaacagacgcaaaagtaaaactaataaaacaagaactcgataaatataaaaatgcagtaaccgaactacaactattaatgcaaagcacacccgcaacaggcagcggatcagcaatagcaagcggagtcgcagtatgtaaagtactacatctagaaggagaagtcaacaaaatcaaatctgcacttctatccacaaacaaagctgtagtatccctatccggatgcggagtctcagtattaacttttaaagtactagaccttaaaaactacatagataaacaactattaccaatactaaataaacaatcatgcagcatatccaatatagagacagtaattgaatttcaacaaaaaaacaacagattactagaaattactcgtgaattttccgtaaatgccggagtcacaacaccagtatcaacctatatgctaacaaacagcgaactacttagcttaataaatgacatgccaataacaaatgaccaaaaaaaacttatgtcaaataacgtacaaatcgtcagacaacaatcctactctataatgtgtataattaaagaagaagtcctagcatacgtagttcaattaccactctatggagtaatagatacaccatgctggaaactacacacgtcaccactatgtacaacaaacacaaaagaaggatccaatatatgcctaacaagaaccgacagaggctggtattgtgacaacgcaggatccgtttcattcttcccacaagcagaaacctgtaaagtacaatctaatagagtattttgcgacacaatgaacagtagaacactaccaagcgaggttaatctatgtaacgtagacatattcaatccaaaatatgattgcaaaataatgacatcaaaaacagatgtatcgtcgagtgtaataacaagtctgggagctatagtaagctgctacggcaagacgaaatgtaccgcttcaaataaatgcagaggaatcattaaaacattctcgaacggatgcgactacgtaagtaataaaggtgtcgacaccgtatcagtagggaatacattatactacgtcaacaaacaagaaggaaaatctctatatgtaaaaggagaaccaataataaatttctatgaccctctagtattcccatcagatgaatttgacgcttccatatcacaagtaaacgaaaaaatcaatcaatctttagcattcatacgaaaaagtgatgaactcctacacaacgtcaacgcaggaaaaagcacaacaaatataatgatcacaacaatcatcatagtaataatagtaatactactatcattaatagcagtaggattattgctttactgcaaagcacgatagggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5807 - RNA, 1923 nt, synthetic construct
  misc_feature 1..1923: note = mRNA product Design c-3 comprising derived and/or modified sequence from HRSV(A2)__F-del_DSCav1_mut5 (opt11)
  source 1..1923: mol_type = other RNA
gggagagtccgctcagccaggttgcagaagcggcttagcgtgtgtcctaatcttctctctgcgtgtaggtaggcctgtgccgcaaacaagcttaccatggaactcctcatcctcaaagccaacgccataaccacaatactcaccgccgtaaccttctgctttgcgtcgggacaaaacatcaccgaagagttctaccaatccacttgctccgcagtaagcaaaggatacctctccgccctgcgaaccggttggtacacatcagtcatcacaatcgaactctcaaacataaaagaaaacaaatgcaacggcaccgacgcaaaggtcaaattaatcaagcaagaactagacaaatacaaaaacgccgtcacagaactccagctgctaatgcagagcacacccgcaactggcagcggatccgccatcgcatcaggagtcgccgtgtgcaaagtcctacacctcgaaggagaagtgaacaaaatcaaatcagccctactctccaccaacaaggccgtcgtctccctctccggctgcggtgtctccgtcctaaccttcaaagtgctagacctcaagaactacatcgacaaacaactcctaccaatactcaacaagcaatcttgctccatctccaacatcgaaaccgtaatcgagttccaacagaagaacaaccgcctcctcgaaatcacccgcgagttctctgtcaacgcaggggtcaccactcccgtctccacatacatgctcacaaactccgaactcctcagcctcatcaacgacatgcccataaccaacgaccagaaaaagctaatgagcaataacgtccaaatcgttagacaacaaagttattccatcatgtgcatcatcaaagaagaagtcctcgcctacgtcgtacaactccccctctatggcgtcatcgacaccccctgctggaaactgcacacatcacccctctgcaccacaaacaccaaagaaggctcaaacatctgcctaactcgcaccgaccgcggctggtactgcgacaacgccggcagcgtatcattctttccccaagccgaaacatgcaaagttcaatccaaccgcgtcttctgcgacacaatgaactccagaacgctccccagcgaagtcaacctctgtaacgtagacatcttcaaccctaagtacgactgcaaaatcatgacctccaaaactgatgtatcctcctccgtcatcacatccctgggcgccatcgtcagctgctacggcaaaacaaaatgcactgcctcaaacaaatgccgaggtatcataaagaccttctcaaacggatgcgattacgtcagcaacaaaggcgtcgacaccgtcagtgtcggcaacaccctctactacgtcaacaaacaagaaggaaaatccctctacgtcaaaggcgaacccatcatcaacttctacgaccccctcgtcttccccagcgacgagttcgacgcctccatctcacaagtcaacgaaaagataaaccaatctctagccttcatccgcaaatccgatgaactcctgcataacgtcaacgccggcaaatccaccacaaacatcatgatcactaccataatcatcgtcataatcgtaatcctcctatctcttatcgcagtcggcctactactctactgcaaagcccgctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5808 - RNA, 1919 nt, synthetic construct
  misc_feature 1..1919: note = mRNA product Design c-4 comprising derived and/or modified sequence from HRSV(A2)__F-del_DSCav1_mut5 (opt1)
  source 1..1919: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5809 - RNA, 1919 nt, synthetic construct
  misc_feature 1..1919: note = mRNA product Design c-4 comprising derived and/or modified sequence from HRSV(A2)__F-del_DSCav1_mut5 (opt1)
  source 1..1919: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcgggtgcggcgtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggggtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggcgtgatcgacacgccgtgctggaagctgcacaccagccccctctgcaccaccaacacgaaggaggggtccaacatctgcctgacccgcaccgaccggggctggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggggccatcgtgtcctgctacggcaagaccaagtgcaccgccagcaacaagtgccgggggatcatcaagaccttctccaacggctgcgactacgtgagcaacaagggcgtcgacacggtgagcgtggggaacaccctctactacgtcaacaagcaggagggcaagtccctgtacgtgaagggggagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccggcaagtccaccaccaacatcatgatcaccacgatcatcatcgtgatcatcgtcatcctcctgagcctgatcgccgtggggctcctgctgtactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5810 - RNA, 1919 nt, synthetic construct
  misc_feature 1..1919: note = mRNA product Design c-4 comprising derived and/or modified sequence from HRSV(A2)__F-del_DSCav1_mut5 (opt2)
  source 1..1919: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5811 - RNA, 1919 nt, synthetic construct
  misc_feature 1..1919: note = mRNA product Design c-4 comprising derived and/or modified sequence from HRSV(A2)__F-del_DSCav1_mut5 (opt3)
  source 1..1919: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcggttgcggggtgtccgtattaacttttaaggttctggaccttaagaactacattgataaacaattgctgcctatcctaaataagcagtcatgtagtattagcaacatcgagaccgtgatagagttccagcagaaaaataacaggctcctggaaattacacgggagttttctgtcaatgcgggagtgactaccccagtgtccacatatatgcttaccaactcagaactgttgagcctcatcaatgacatgccgattacgaacgatcaaaagaaactgatgagtaacaatgtccagatcgttcgccagcagtcttactccatcatgtgcattataaaggaggaagtgttagcatatgtagtgcaactgcccctctacggcgtcatcgacactccttgttggaaacttcatacaagcccactgtgcaccactaacacaaaggagggctcgaatatttgtttgacccgaacggatcgtgggtggtactgcgacaacgccggatctgtgtccttctttccccaggctgaaacctgtaaggttcagtcaaatagagtgttctgcgatacaatgaacagtagaactctgcctagcgaggtcaatctctgcaacgtggacatctttaatccaaaatatgattgtaagataatgacctccaaaacagacgtatctagctcagttattaccagtctgggtgccatcgtgtcctgctacggcaagactaaatgtacagcaagcaacaagtgcagggggatcattaagaccttctctaatggatgtgattatgtctcaaacaaaggcgtggacactgtcagtgtgggtaatacgctttactatgttaacaagcaagaggggaaaagcctgtacgtgaagggagaacccatcattaatttttatgaccctttggtattcccatccgatgagtttgacgcttctatatcgcaggtcaacgagaaaatcaaccagagcctcgccttcattcggaagtccgatgaactgttacacaatgtgaacgcgggcaagtcaacaaccaatatcatgatcactaccattataatcgttattatcgtgattctgctaagtctcatcgccgtcggcctgcttttgtactgcaaagcacgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5812 - RNA, 1919 nt, synthetic construct
  misc_feature 1..1919: note = mRNA product Design c-4 comprising derived and/or modified sequence from HRSV(A2)__F-del_DSCav1_mut5 (opt4)
  source 1..1919: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5813 - RNA, 1919 nt, synthetic construct
  misc_feature 1..1919: note = mRNA product Design c-4 comprising derived and/or modified sequence from HRSV(A2)__F-del_DSCav1_mut5 (opt5)
  source 1..1919: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcggatgcggcgtttctgtgctgacatttaaggtccttgacctgaagaactacattgataaacaactcctgcctatcctgaataagcagtcctgtagcatttctaacatcgagaccgtgattgagttccagcagaaaaataaccggctcctggaaatcacgcgcgagttttccgtgaatgccggcgtcacaaccccggttagcacatatatgcttaccaactccgaactgctctctctgatcaatgacatgcccattaccaacgatcaaaagaaacttatgagcaacaatgtgcagatcgtgagacagcagtcctacagcattatgtgcatcattaaggaggaagtcctggcttatgtggttcaactccctctgtacggggtgatcgacacaccctgttggaaactgcatacgtctcctctctgcaccacaaacaccaaggagggatccaatatctgtctgacacggaccgatcgcggctggtactgcgacaacgccgggagcgtctctttctttccccaggcggaaacgtgtaaggtgcagagcaatagagttttctgcgatacaatgaactccagaaccctgccttctgaggtgaatctctgcaacgtcgacatttttaatccgaaatatgattgtaagatcatgaccagcaaaacagacgtgtccagctctgtcattacctccctgggagccatcgtgagctgctacggcaagacaaaatgtacggcttctaacaagtgccgggggattatcaagaccttctccaatggatgtgattatgttagcaacaaaggcgtggacacagtctccgtgggcaataccctttactatgttaacaagcaagaggggaaatctctgtacgtgaagggagaacccatcattaatttttatgaccctctcgtcttccccagcgatgagtttgacgcctccatctctcaggtgaacgagaaaattaaccagagcctggctttcatccgcaagtccgatgaactgctccacaatgtgaacgccggcaagagcacaaccaatattatgatcacgaccattatcatcgttattatcgtcattctgctttctctgatcgccgtggggctcctgctgtactgcaaagctagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5814 - RNA, 1919 nt, synthetic construct
  misc_feature 1..1919: note = mRNA product Design c-4 comprising derived and/or modified sequence from HRSV(A2)__F-del_DSCav1_mut5 (opt6)
  source 1..1919: mol_type = other RNA
gggagagtccgctcagccaggttgcagaagcggcttagcgtgtgtcctaatcttctctctgcgtgtaggtaggcctgtgccgcaaacaagcttaccatggaacttttaatactgaaagcaaatgccatcacaaccatactaactgccgtcacattctgctttgcatcaggacaaaacataacagaagaattttaccaatccacatgctcagcagtatcaaaaggatatctatcggcacttagaactggatggtacacaagtgttataactatagaactctcaaacataaaagaaaacaaatgcaatggaacagacgcaaaagtaaaactaataaaacaagaactcgataaatataaaaatgcagtaaccgaactacaactattaatgcaaagcacacccgcaacaggcagcggatcagcaatagcaagcggagtcgcagtatgtaaagtactacatctagaaggagaagtcaacaaaatcaaatctgcacttctatccacaaacaaagctgtagtatccctatccggatgcggagtctcagtattaacttttaaagtactagaccttaaaaactacatagataaacaactattaccaatactaaataaacaatcatgcagcatatccaatatagagacagtaattgaatttcaacaaaaaaacaacagattactagaaattactcgtgaattttccgtaaatgccggagtcacaacaccagtatcaacctatatgctaacaaacagcgaactacttagcttaataaatgacatgccaataacaaatgaccaaaaaaaacttatgtcaaataacgtacaaatcgtcagacaacaatcctactctataatgtgtataattaaagaagaagtcctagcatacgtagttcaattaccactctatggagtaatagatacaccatgctggaaactacacacgtcaccactatgtacaacaaacacaaaagaaggatccaatatatgcctaacaagaaccgacagaggctggtattgtgacaacgcaggatccgtttcattcttcccacaagcagaaacctgtaaagtacaatctaatagagtattttgcgacacaatgaacagtagaacactaccaagcgaggttaatctatgtaacgtagacatattcaatccaaaatatgattgcaaaataatgacatcaaaaacagatgtatcgtcgagtgtaataacaagtctgggagctatagtaagctgctacggcaagacgaaatgtaccgcttcaaataaatgcagaggaatcattaaaacattctcgaacggatgcgactacgtaagtaataaaggtgtcgacaccgtatcagtagggaatacattatactacgtcaacaaacaagaaggaaaatctctatatgtaaaaggagaaccaataataaatttctatgaccctctagtattcccatcagatgaatttgacgcttccatatcacaagtaaacgaaaaaatcaatcaatctttagcattcatacgaaaaagtgatgaactcctacacaacgtcaacgcaggaaaaagcacaacaaatataatgatcacaacaatcatcatagtaataatagtaatactactatcattaatagcagtaggattattgctttactgcaaagcacgatagggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5815 - RNA, 1919 nt, synthetic construct
  misc_feature 1..1919: note = mRNA product Design c-4 comprising derived and/or modified sequence from HRSV(A2)__F-del_DSCav1_mut5 (opt11)
  source 1..1919: mol_type = other RNA
gggagagtccgctcagccaggttgcagaagcggcttagcgtgtgtcctaatcttctctctgcgtgtaggtaggcctgtgccgcaaacaagcttaccatggaactcctcatcctcaaagccaacgccataaccacaatactcaccgccgtaaccttctgctttgcgtcgggacaaaacatcaccgaagagttctaccaatccacttgctccgcagtaagcaaaggatacctctccgccctgcgaaccggttggtacacatcagtcatcacaatcgaactctcaaacataaaagaaaacaaatgcaacggcaccgacgcaaaggtcaaattaatcaagcaagaactagacaaatacaaaaacgccgtcacagaactccagctgctaatgcagagcacacccgcaactggcagcggatccgccatcgcatcaggagtcgccgtgtgcaaagtcctacacctcgaaggagaagtgaacaaaatcaaatcagccctactctccaccaacaaggccgtcgtctccctctccggctgcggtgtctccgtcctaaccttcaaagtgctagacctcaagaactacatcgacaaacaactcctaccaatactcaacaagcaatcttgctccatctccaacatcgaaaccgtaatcgagttccaacagaagaacaaccgcctcctcgaaatcacccgcgagttctctgtcaacgcaggggtcaccactcccgtctccacatacatgctcacaaactccgaactcctcagcctcatcaacgacatgcccataaccaacgaccagaaaaagctaatgagcaataacgtccaaatcgttagacaacaaagttattccatcatgtgcatcatcaaagaagaagtcctcgcctacgtcgtacaactccccctctatggcgtcatcgacaccccctgctggaaactgcacacatcacccctctgcaccacaaacaccaaagaaggctcaaacatctgcctaactcgcaccgaccgcggctggtactgcgacaacgccggcagcgtatcattctttccccaagccgaaacatgcaaagttcaatccaaccgcgtcttctgcgacacaatgaactccagaacgctccccagcgaagtcaacctctgtaacgtagacatcttcaaccctaagtacgactgcaaaatcatgacctccaaaactgatgtatcctcctccgtcatcacatccctgggcgccatcgtcagctgctacggcaaaacaaaatgcactgcctcaaacaaatgccgaggtatcataaagaccttctcaaacggatgcgattacgtcagcaacaaaggcgtcgacaccgtcagtgtcggcaacaccctctactacgtcaacaaacaagaaggaaaatccctctacgtcaaaggcgaacccatcatcaacttctacgaccccctcgtcttccccagcgacgagttcgacgcctccatctcacaagtcaacgaaaagataaaccaatctctagccttcatccgcaaatccgatgaactcctgcataacgtcaacgccggcaaatccaccacaaacatcatgatcactaccataatcatcgtcataatcgtaatcctcctatctcttatcgcagtcggcctactactctactgcaaagcccgctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5816 - RNA, 1837 nt, synthetic construct
  misc_feature 1..1837: note = mRNA product Design c-5 comprising derived and/or modified sequence from HRSV(A2)__F-del_DSCav1_mut5 (opt1)
  source 1..1837: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5817 - RNA, 1837 nt, synthetic construct
  misc_feature 1..1837: note = mRNA product Design c-5 comprising derived and/or modified sequence from HRSV(A2)__F-del_DSCav1_mut5 (opt1)
  source 1..1837: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcgggtgcggcgtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggggtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggcgtgatcgacacgccgtgctggaagctgcacaccagccccctctgcaccaccaacacgaaggaggggtccaacatctgcctgacccgcaccgaccggggctggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggggccatcgtgtcctgctacggcaagaccaagtgcaccgccagcaacaagtgccgggggatcatcaagaccttctccaacggctgcgactacgtgagcaacaagggcgtcgacacggtgagcgtggggaacaccctctactacgtcaacaagcaggagggcaagtccctgtacgtgaagggggagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccggcaagtccaccaccaacatcatgatcaccacgatcatcatcgtgatcatcgtcatcctcctgagcctgatcgccgtggggctcctgctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5818 - RNA, 1837 nt, synthetic construct
  misc_feature 1..1837: note = mRNA product Design c-5 comprising derived and/or modified sequence from HRSV(A2)__F-del_DSCav1_mut5 (opt2)
  source 1..1837: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5819 - RNA, 1837 nt, synthetic construct
  misc_feature 1..1837: note = mRNA product Design c-5 comprising derived and/or modified sequence from HRSV(A2)__F-del_DSCav1_mut5 (opt3)
  source 1..1837: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcggttgcggggtgtccgtattaacttttaaggttctggaccttaagaactacattgataaacaattgctgcctatcctaaataagcagtcatgtagtattagcaacatcgagaccgtgatagagttccagcagaaaaataacaggctcctggaaattacacgggagttttctgtcaatgcgggagtgactaccccagtgtccacatatatgcttaccaactcagaactgttgagcctcatcaatgacatgccgattacgaacgatcaaaagaaactgatgagtaacaatgtccagatcgttcgccagcagtcttactccatcatgtgcattataaaggaggaagtgttagcatatgtagtgcaactgcccctctacggcgtcatcgacactccttgttggaaacttcatacaagcccactgtgcaccactaacacaaaggagggctcgaatatttgtttgacccgaacggatcgtgggtggtactgcgacaacgccggatctgtgtccttctttccccaggctgaaacctgtaaggttcagtcaaatagagtgttctgcgatacaatgaacagtagaactctgcctagcgaggtcaatctctgcaacgtggacatctttaatccaaaatatgattgtaagataatgacctccaaaacagacgtatctagctcagttattaccagtctgggtgccatcgtgtcctgctacggcaagactaaatgtacagcaagcaacaagtgcagggggatcattaagaccttctctaatggatgtgattatgtctcaaacaaaggcgtggacactgtcagtgtgggtaatacgctttactatgttaacaagcaagaggggaaaagcctgtacgtgaagggagaacccatcattaatttttatgaccctttggtattcccatccgatgagtttgacgcttctatatcgcaggtcaacgagaaaatcaaccagagcctcgccttcattcggaagtccgatgaactgttacacaatgtgaacgcgggcaagtcaacaaccaatatcatgatcactaccattataatcgttattatcgtgattctgctaagtctcatcgccgtcggcctgcttttgtactgcaaagcacgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5820 - RNA, 1837 nt, synthetic construct
  misc_feature 1..1837: note = mRNA product Design c-5 comprising derived and/or modified sequence from HRSV(A2)__F-del_DSCav1_mut5 (opt4)
  source 1..1837: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5821 - RNA, 1837 nt, synthetic construct
  misc_feature 1..1837: note = mRNA product Design c-5 comprising derived and/or modified sequence from HRSV(A2)__F-del_DSCav1_mut5 (opt5)
  source 1..1837: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcggatgcggcgtttctgtgctgacatttaaggtccttgacctgaagaactacattgataaacaactcctgcctatcctgaataagcagtcctgtagcatttctaacatcgagaccgtgattgagttccagcagaaaaataaccggctcctggaaatcacgcgcgagttttccgtgaatgccggcgtcacaaccccggttagcacatatatgcttaccaactccgaactgctctctctgatcaatgacatgcccattaccaacgatcaaaagaaacttatgagcaacaatgtgcagatcgtgagacagcagtcctacagcattatgtgcatcattaaggaggaagtcctggcttatgtggttcaactccctctgtacggggtgatcgacacaccctgttggaaactgcatacgtctcctctctgcaccacaaacaccaaggagggatccaatatctgtctgacacggaccgatcgcggctggtactgcgacaacgccgggagcgtctctttctttccccaggcggaaacgtgtaaggtgcagagcaatagagttttctgcgatacaatgaactccagaaccctgccttctgaggtgaatctctgcaacgtcgacatttttaatccgaaatatgattgtaagatcatgaccagcaaaacagacgtgtccagctctgtcattacctccctgggagccatcgtgagctgctacggcaagacaaaatgtacggcttctaacaagtgccgggggattatcaagaccttctccaatggatgtgattatgttagcaacaaaggcgtggacacagtctccgtgggcaataccctttactatgttaacaagcaagaggggaaatctctgtacgtgaagggagaacccatcattaatttttatgaccctctcgtcttccccagcgatgagtttgacgcctccatctctcaggtgaacgagaaaattaaccagagcctggctttcatccgcaagtccgatgaactgctccacaatgtgaacgccggcaagagcacaaccaatattatgatcacgaccattatcatcgttattatcgtcattctgctttctctgatcgccgtggggctcctgctgtactgcaaagctagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5822 - RNA, 1837 nt, synthetic construct
  misc_feature 1..1837: note = mRNA product Design c-5 comprising derived and/or modified sequence from HRSV(A2)__F-del_DSCav1_mut5 (opt6)
  source 1..1837: mol_type = other RNA
gggagagcggctcggccattttgtcccagtcagtccggaggctgcggctgcagaagtaccgcctgcggagtaactgcaaagaagcttaccatggaacttttaatactgaaagcaaatgccatcacaaccatactaactgccgtcacattctgctttgcatcaggacaaaacataacagaagaattttaccaatccacatgctcagcagtatcaaaaggatatctatcggcacttagaactggatggtacacaagtgttataactatagaactctcaaacataaaagaaaacaaatgcaatggaacagacgcaaaagtaaaactaataaaacaagaactcgataaatataaaaatgcagtaaccgaactacaactattaatgcaaagcacacccgcaacaggcagcggatcagcaatagcaagcggagtcgcagtatgtaaagtactacatctagaaggagaagtcaacaaaatcaaatctgcacttctatccacaaacaaagctgtagtatccctatccggatgcggagtctcagtattaacttttaaagtactagaccttaaaaactacatagataaacaactattaccaatactaaataaacaatcatgcagcatatccaatatagagacagtaattgaatttcaacaaaaaaacaacagattactagaaattactcgtgaattttccgtaaatgccggagtcacaacaccagtatcaacctatatgctaacaaacagcgaactacttagcttaataaatgacatgccaataacaaatgaccaaaaaaaacttatgtcaaataacgtacaaatcgtcagacaacaatcctactctataatgtgtataattaaagaagaagtcctagcatacgtagttcaattaccactctatggagtaatagatacaccatgctggaaactacacacgtcaccactatgtacaacaaacacaaaagaaggatccaatatatgcctaacaagaaccgacagaggctggtattgtgacaacgcaggatccgtttcattcttcccacaagcagaaacctgtaaagtacaatctaatagagtattttgcgacacaatgaacagtagaacactaccaagcgaggttaatctatgtaacgtagacatattcaatccaaaatatgattgcaaaataatgacatcaaaaacagatgtatcgtcgagtgtaataacaagtctgggagctatagtaagctgctacggcaagacgaaatgtaccgcttcaaataaatgcagaggaatcattaaaacattctcgaacggatgcgactacgtaagtaataaaggtgtcgacaccgtatcagtagggaatacattatactacgtcaacaaacaagaaggaaaatctctatatgtaaaaggagaaccaataataaatttctatgaccctctagtattcccatcagatgaatttgacgcttccatatcacaagtaaacgaaaaaatcaatcaatctttagcattcatacgaaaaagtgatgaactcctacacaacgtcaacgcaggaaaaagcacaacaaatataatgatcacaacaatcatcatagtaataatagtaatactactatcattaatagcagtaggattattgctttactgcaaagcacgatagggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5823 - RNA, 1837 nt, synthetic construct
  misc_feature 1..1837: note = mRNA product Design c-5 comprising derived and/or modified sequence from HRSV(A2)__F-del_DSCav1_mut5 (opt11)
  source 1..1837: mol_type = other RNA
gggagagcggctcggccattttgtcccagtcagtccggaggctgcggctgcagaagtaccgcctgcggagtaactgcaaagaagcttaccatggaactcctcatcctcaaagccaacgccataaccacaatactcaccgccgtaaccttctgctttgcgtcgggacaaaacatcaccgaagagttctaccaatccacttgctccgcagtaagcaaaggatacctctccgccctgcgaaccggttggtacacatcagtcatcacaatcgaactctcaaacataaaagaaaacaaatgcaacggcaccgacgcaaaggtcaaattaatcaagcaagaactagacaaatacaaaaacgccgtcacagaactccagctgctaatgcagagcacacccgcaactggcagcggatccgccatcgcatcaggagtcgccgtgtgcaaagtcctacacctcgaaggagaagtgaacaaaatcaaatcagccctactctccaccaacaaggccgtcgtctccctctccggctgcggtgtctccgtcctaaccttcaaagtgctagacctcaagaactacatcgacaaacaactcctaccaatactcaacaagcaatcttgctccatctccaacatcgaaaccgtaatcgagttccaacagaagaacaaccgcctcctcgaaatcacccgcgagttctctgtcaacgcaggggtcaccactcccgtctccacatacatgctcacaaactccgaactcctcagcctcatcaacgacatgcccataaccaacgaccagaaaaagctaatgagcaataacgtccaaatcgttagacaacaaagttattccatcatgtgcatcatcaaagaagaagtcctcgcctacgtcgtacaactccccctctatggcgtcatcgacaccccctgctggaaactgcacacatcacccctctgcaccacaaacaccaaagaaggctcaaacatctgcctaactcgcaccgaccgcggctggtactgcgacaacgccggcagcgtatcattctttccccaagccgaaacatgcaaagttcaatccaaccgcgtcttctgcgacacaatgaactccagaacgctccccagcgaagtcaacctctgtaacgtagacatcttcaaccctaagtacgactgcaaaatcatgacctccaaaactgatgtatcctcctccgtcatcacatccctgggcgccatcgtcagctgctacggcaaaacaaaatgcactgcctcaaacaaatgccgaggtatcataaagaccttctcaaacggatgcgattacgtcagcaacaaaggcgtcgacaccgtcagtgtcggcaacaccctctactacgtcaacaaacaagaaggaaaatccctctacgtcaaaggcgaacccatcatcaacttctacgaccccctcgtcttccccagcgacgagttcgacgcctccatctcacaagtcaacgaaaagataaaccaatctctagccttcatccgcaaatccgatgaactcctgcataacgtcaacgccggcaaatccaccacaaacatcatgatcactaccataatcatcgtcataatcgtaatcctcctatctcttatcgcagtcggcctactactctactgcaaagcccgctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5824 - RNA, 1846 nt, synthetic construct
  misc_feature 1..1846: note = mRNA product Design d-1 comprising derived and/or modified sequence from HRSV(A2)__F-del_DSCav1_mut5 (opt1)
  source 1..1846: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5825 - RNA, 1846 nt, synthetic construct
  misc_feature 1..1846: note = mRNA product Design d-1 comprising derived and/or modified sequence from HRSV(A2)__F-del_DSCav1_mut5 (opt1)
  source 1..1846: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcgggtgcggcgtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggggtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggcgtgatcgacacgccgtgctggaagctgcacaccagccccctctgcaccaccaacacgaaggaggggtccaacatctgcctgacccgcaccgaccggggctggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggggccatcgtgtcctgctacggcaagaccaagtgcaccgccagcaacaagtgccgggggatcatcaagaccttctccaacggctgcgactacgtgagcaacaagggcgtcgacacggtgagcgtggggaacaccctctactacgtcaacaagcaggagggcaagtccctgtacgtgaagggggagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccggcaagtccaccaccaacatcatgatcaccacgatcatcatcgtgatcatcgtcatcctcctgagcctgatcgccgtggggctcctgctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5826 - RNA, 1846 nt, synthetic construct
  misc_feature 1..1846: note = mRNA product Design d-1 comprising derived and/or modified sequence from HRSV(A2)__F-del_DSCav1_mut5 (opt2)
  source 1..1846: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5827 - RNA, 1846 nt, synthetic construct
  misc_feature 1..1846: note = mRNA product Design d-1 comprising derived and/or modified sequence from HRSV(A2)__F-del_DSCav1_mut5 (opt3)
  source 1..1846: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcggttgcggggtgtccgtattaacttttaaggttctggaccttaagaactacattgataaacaattgctgcctatcctaaataagcagtcatgtagtattagcaacatcgagaccgtgatagagttccagcagaaaaataacaggctcctggaaattacacgggagttttctgtcaatgcgggagtgactaccccagtgtccacatatatgcttaccaactcagaactgttgagcctcatcaatgacatgccgattacgaacgatcaaaagaaactgatgagtaacaatgtccagatcgttcgccagcagtcttactccatcatgtgcattataaaggaggaagtgttagcatatgtagtgcaactgcccctctacggcgtcatcgacactccttgttggaaacttcatacaagcccactgtgcaccactaacacaaaggagggctcgaatatttgtttgacccgaacggatcgtgggtggtactgcgacaacgccggatctgtgtccttctttccccaggctgaaacctgtaaggttcagtcaaatagagtgttctgcgatacaatgaacagtagaactctgcctagcgaggtcaatctctgcaacgtggacatctttaatccaaaatatgattgtaagataatgacctccaaaacagacgtatctagctcagttattaccagtctgggtgccatcgtgtcctgctacggcaagactaaatgtacagcaagcaacaagtgcagggggatcattaagaccttctctaatggatgtgattatgtctcaaacaaaggcgtggacactgtcagtgtgggtaatacgctttactatgttaacaagcaagaggggaaaagcctgtacgtgaagggagaacccatcattaatttttatgaccctttggtattcccatccgatgagtttgacgcttctatatcgcaggtcaacgagaaaatcaaccagagcctcgccttcattcggaagtccgatgaactgttacacaatgtgaacgcgggcaagtcaacaaccaatatcatgatcactaccattataatcgttattatcgtgattctgctaagtctcatcgccgtcggcctgcttttgtactgcaaagcacgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5828 - RNA, 1846 nt, synthetic construct
  misc_feature 1..1846: note = mRNA product Design d-1 comprising derived and/or modified sequence from HRSV(A2)__F-del_DSCav1_mut5 (opt4)
  source 1..1846: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5829 - RNA, 1846 nt, synthetic construct
  misc_feature 1..1846: note = mRNA product Design d-1 comprising derived and/or modified sequence from HRSV(A2)__F-del_DSCav1_mut5 (opt5)
  source 1..1846: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcggatgcggcgtttctgtgctgacatttaaggtccttgacctgaagaactacattgataaacaactcctgcctatcctgaataagcagtcctgtagcatttctaacatcgagaccgtgattgagttccagcagaaaaataaccggctcctggaaatcacgcgcgagttttccgtgaatgccggcgtcacaaccccggttagcacatatatgcttaccaactccgaactgctctctctgatcaatgacatgcccattaccaacgatcaaaagaaacttatgagcaacaatgtgcagatcgtgagacagcagtcctacagcattatgtgcatcattaaggaggaagtcctggcttatgtggttcaactccctctgtacggggtgatcgacacaccctgttggaaactgcatacgtctcctctctgcaccacaaacaccaaggagggatccaatatctgtctgacacggaccgatcgcggctggtactgcgacaacgccgggagcgtctctttctttccccaggcggaaacgtgtaaggtgcagagcaatagagttttctgcgatacaatgaactccagaaccctgccttctgaggtgaatctctgcaacgtcgacatttttaatccgaaatatgattgtaagatcatgaccagcaaaacagacgtgtccagctctgtcattacctccctgggagccatcgtgagctgctacggcaagacaaaatgtacggcttctaacaagtgccgggggattatcaagaccttctccaatggatgtgattatgttagcaacaaaggcgtggacacagtctccgtgggcaataccctttactatgttaacaagcaagaggggaaatctctgtacgtgaagggagaacccatcattaatttttatgaccctctcgtcttccccagcgatgagtttgacgcctccatctctcaggtgaacgagaaaattaaccagagcctggctttcatccgcaagtccgatgaactgctccacaatgtgaacgccggcaagagcacaaccaatattatgatcacgaccattatcatcgttattatcgtcattctgctttctctgatcgccgtggggctcctgctgtactgcaaagctagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5830 - RNA, 1846 nt, synthetic construct
  misc_feature 1..1846: note = mRNA product Design d-1 comprising derived and/or modified sequence from HRSV(A2)__F-del_DSCav1_mut5 (opt6)
  source 1..1846: mol_type = other RNA
gggagacccgtgacccggaagttgtacggctacgcgactttccctcccacaaaccctcgcgcccttcctttcctacttgggcccggcagaaagcttaccatggaacttttaatactgaaagcaaatgccatcacaaccatactaactgccgtcacattctgctttgcatcaggacaaaacataacagaagaattttaccaatccacatgctcagcagtatcaaaaggatatctatcggcacttagaactggatggtacacaagtgttataactatagaactctcaaacataaaagaaaacaaatgcaatggaacagacgcaaaagtaaaactaataaaacaagaactcgataaatataaaaatgcagtaaccgaactacaactattaatgcaaagcacacccgcaacaggcagcggatcagcaatagcaagcggagtcgcagtatgtaaagtactacatctagaaggagaagtcaacaaaatcaaatctgcacttctatccacaaacaaagctgtagtatccctatccggatgcggagtctcagtattaacttttaaagtactagaccttaaaaactacatagataaacaactattaccaatactaaataaacaatcatgcagcatatccaatatagagacagtaattgaatttcaacaaaaaaacaacagattactagaaattactcgtgaattttccgtaaatgccggagtcacaacaccagtatcaacctatatgctaacaaacagcgaactacttagcttaataaatgacatgccaataacaaatgaccaaaaaaaacttatgtcaaataacgtacaaatcgtcagacaacaatcctactctataatgtgtataattaaagaagaagtcctagcatacgtagttcaattaccactctatggagtaatagatacaccatgctggaaactacacacgtcaccactatgtacaacaaacacaaaagaaggatccaatatatgcctaacaagaaccgacagaggctggtattgtgacaacgcaggatccgtttcattcttcccacaagcagaaacctgtaaagtacaatctaatagagtattttgcgacacaatgaacagtagaacactaccaagcgaggttaatctatgtaacgtagacatattcaatccaaaatatgattgcaaaataatgacatcaaaaacagatgtatcgtcgagtgtaataacaagtctgggagctatagtaagctgctacggcaagacgaaatgtaccgcttcaaataaatgcagaggaatcattaaaacattctcgaacggatgcgactacgtaagtaataaaggtgtcgacaccgtatcagtagggaatacattatactacgtcaacaaacaagaaggaaaatctctatatgtaaaaggagaaccaataataaatttctatgaccctctagtattcccatcagatgaatttgacgcttccatatcacaagtaaacgaaaaaatcaatcaatctttagcattcatacgaaaaagtgatgaactcctacacaacgtcaacgcaggaaaaagcacaacaaatataatgatcacaacaatcatcatagtaataatagtaatactactatcattaatagcagtaggattattgctttactgcaaagcacgatagggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5831 - RNA, 1846 nt, synthetic construct
  misc_feature 1..1846: note = mRNA product Design d-1 comprising derived and/or modified sequence from HRSV(A2)__F-del_DSCav1_mut5 (opt11)
  source 1..1846: mol_type = other RNA
gggagacccgtgacccggaagttgtacggctacgcgactttccctcccacaaaccctcgcgcccttcctttcctacttgggcccggcagaaagcttaccatggaactcctcatcctcaaagccaacgccataaccacaatactcaccgccgtaaccttctgctttgcgtcgggacaaaacatcaccgaagagttctaccaatccacttgctccgcagtaagcaaaggatacctctccgccctgcgaaccggttggtacacatcagtcatcacaatcgaactctcaaacataaaagaaaacaaatgcaacggcaccgacgcaaaggtcaaattaatcaagcaagaactagacaaatacaaaaacgccgtcacagaactccagctgctaatgcagagcacacccgcaactggcagcggatccgccatcgcatcaggagtcgccgtgtgcaaagtcctacacctcgaaggagaagtgaacaaaatcaaatcagccctactctccaccaacaaggccgtcgtctccctctccggctgcggtgtctccgtcctaaccttcaaagtgctagacctcaagaactacatcgacaaacaactcctaccaatactcaacaagcaatcttgctccatctccaacatcgaaaccgtaatcgagttccaacagaagaacaaccgcctcctcgaaatcacccgcgagttctctgtcaacgcaggggtcaccactcccgtctccacatacatgctcacaaactccgaactcctcagcctcatcaacgacatgcccataaccaacgaccagaaaaagctaatgagcaataacgtccaaatcgttagacaacaaagttattccatcatgtgcatcatcaaagaagaagtcctcgcctacgtcgtacaactccccctctatggcgtcatcgacaccccctgctggaaactgcacacatcacccctctgcaccacaaacaccaaagaaggctcaaacatctgcctaactcgcaccgaccgcggctggtactgcgacaacgccggcagcgtatcattctttccccaagccgaaacatgcaaagttcaatccaaccgcgtcttctgcgacacaatgaactccagaacgctccccagcgaagtcaacctctgtaacgtagacatcttcaaccctaagtacgactgcaaaatcatgacctccaaaactgatgtatcctcctccgtcatcacatccctgggcgccatcgtcagctgctacggcaaaacaaaatgcactgcctcaaacaaatgccgaggtatcataaagaccttctcaaacggatgcgattacgtcagcaacaaaggcgtcgacaccgtcagtgtcggcaacaccctctactacgtcaacaaacaagaaggaaaatccctctacgtcaaaggcgaacccatcatcaacttctacgaccccctcgtcttccccagcgacgagttcgacgcctccatctcacaagtcaacgaaaagataaaccaatctctagccttcatccgcaaatccgatgaactcctgcataacgtcaacgccggcaaatccaccacaaacatcatgatcactaccataatcatcgtcataatcgtaatcctcctatctcttatcgcagtcggcctactactctactgcaaagcccgctaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5832 - RNA, 1901 nt, synthetic construct
  misc_feature 1..1901: note = mRNA product Design d-2 comprising derived and/or modified sequence from HRSV(A2)__F-del_DSCav1_mut5 (opt1)
  source 1..1901: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5833 - RNA, 1901 nt, synthetic construct
  misc_feature 1..1901: note = mRNA product Design d-2 comprising derived and/or modified sequence from HRSV(A2)__F-del_DSCav1_mut5 (opt1)
  source 1..1901: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcgggtgcggcgtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggggtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggcgtgatcgacacgccgtgctggaagctgcacaccagccccctctgcaccaccaacacgaaggaggggtccaacatctgcctgacccgcaccgaccggggctggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggggccatcgtgtcctgctacggcaagaccaagtgcaccgccagcaacaagtgccgggggatcatcaagaccttctccaacggctgcgactacgtgagcaacaagggcgtcgacacggtgagcgtggggaacaccctctactacgtcaacaagcaggagggcaagtccctgtacgtgaagggggagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccggcaagtccaccaccaacatcatgatcaccacgatcatcatcgtgatcatcgtcatcctcctgagcctgatcgccgtggggctcctgctgtactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5834 - RNA, 1901 nt, synthetic construct
  misc_feature 1..1901: note = mRNA product Design d-2 comprising derived and/or modified sequence from HRSV(A2)__F-del_DSCav1_mut5 (opt2)
  source 1..1901: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5835 - RNA, 1901 nt, synthetic construct
  misc_feature 1..1901: note = mRNA product Design d-2 comprising derived and/or modified sequence from HRSV(A2)__F-del_DSCav1_mut5 (opt3)
  source 1..1901: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcggttgcggggtgtccgtattaacttttaaggttctggaccttaagaactacattgataaacaattgctgcctatcctaaataagcagtcatgtagtattagcaacatcgagaccgtgatagagttccagcagaaaaataacaggctcctggaaattacacgggagttttctgtcaatgcgggagtgactaccccagtgtccacatatatgcttaccaactcagaactgttgagcctcatcaatgacatgccgattacgaacgatcaaaagaaactgatgagtaacaatgtccagatcgttcgccagcagtcttactccatcatgtgcattataaaggaggaagtgttagcatatgtagtgcaactgcccctctacggcgtcatcgacactccttgttggaaacttcatacaagcccactgtgcaccactaacacaaaggagggctcgaatatttgtttgacccgaacggatcgtgggtggtactgcgacaacgccggatctgtgtccttctttccccaggctgaaacctgtaaggttcagtcaaatagagtgttctgcgatacaatgaacagtagaactctgcctagcgaggtcaatctctgcaacgtggacatctttaatccaaaatatgattgtaagataatgacctccaaaacagacgtatctagctcagttattaccagtctgggtgccatcgtgtcctgctacggcaagactaaatgtacagcaagcaacaagtgcagggggatcattaagaccttctctaatggatgtgattatgtctcaaacaaaggcgtggacactgtcagtgtgggtaatacgctttactatgttaacaagcaagaggggaaaagcctgtacgtgaagggagaacccatcattaatttttatgaccctttggtattcccatccgatgagtttgacgcttctatatcgcaggtcaacgagaaaatcaaccagagcctcgccttcattcggaagtccgatgaactgttacacaatgtgaacgcgggcaagtcaacaaccaatatcatgatcactaccattataatcgttattatcgtgattctgctaagtctcatcgccgtcggcctgcttttgtactgcaaagcacgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5836 - RNA, 1901 nt, synthetic construct
  misc_feature 1..1901: note = mRNA product Design d-2 comprising derived and/or modified sequence from HRSV(A2)__F-del_DSCav1_mut5 (opt4)
  source 1..1901: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5837 - RNA, 1901 nt, synthetic construct
  misc_feature 1..1901: note = mRNA product Design d-2 comprising derived and/or modified sequence from HRSV(A2)__F-del_DSCav1_mut5 (opt5)
  source 1..1901: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcggatgcggcgtttctgtgctgacatttaaggtccttgacctgaagaactacattgataaacaactcctgcctatcctgaataagcagtcctgtagcatttctaacatcgagaccgtgattgagttccagcagaaaaataaccggctcctggaaatcacgcgcgagttttccgtgaatgccggcgtcacaaccccggttagcacatatatgcttaccaactccgaactgctctctctgatcaatgacatgcccattaccaacgatcaaaagaaacttatgagcaacaatgtgcagatcgtgagacagcagtcctacagcattatgtgcatcattaaggaggaagtcctggcttatgtggttcaactccctctgtacggggtgatcgacacaccctgttggaaactgcatacgtctcctctctgcaccacaaacaccaaggagggatccaatatctgtctgacacggaccgatcgcggctggtactgcgacaacgccgggagcgtctctttctttccccaggcggaaacgtgtaaggtgcagagcaatagagttttctgcgatacaatgaactccagaaccctgccttctgaggtgaatctctgcaacgtcgacatttttaatccgaaatatgattgtaagatcatgaccagcaaaacagacgtgtccagctctgtcattacctccctgggagccatcgtgagctgctacggcaagacaaaatgtacggcttctaacaagtgccgggggattatcaagaccttctccaatggatgtgattatgttagcaacaaaggcgtggacacagtctccgtgggcaataccctttactatgttaacaagcaagaggggaaatctctgtacgtgaagggagaacccatcattaatttttatgaccctctcgtcttccccagcgatgagtttgacgcctccatctctcaggtgaacgagaaaattaaccagagcctggctttcatccgcaagtccgatgaactgctccacaatgtgaacgccggcaagagcacaaccaatattatgatcacgaccattatcatcgttattatcgtcattctgctttctctgatcgccgtggggctcctgctgtactgcaaagctagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5838 - RNA, 1901 nt, synthetic construct
  misc_feature 1..1901: note = mRNA product Design d-2 comprising derived and/or modified sequence from HRSV(A2)__F-del_DSCav1_mut5 (opt6)
  source 1..1901: mol_type = other RNA
gggagagcggctcggccattttgtcccagtcagtccggaggctgcggctgcagaagtaccgcctgcggagtaactgcaaagaagcttaccatggaacttttaatactgaaagcaaatgccatcacaaccatactaactgccgtcacattctgctttgcatcaggacaaaacataacagaagaattttaccaatccacatgctcagcagtatcaaaaggatatctatcggcacttagaactggatggtacacaagtgttataactatagaactctcaaacataaaagaaaacaaatgcaatggaacagacgcaaaagtaaaactaataaaacaagaactcgataaatataaaaatgcagtaaccgaactacaactattaatgcaaagcacacccgcaacaggcagcggatcagcaatagcaagcggagtcgcagtatgtaaagtactacatctagaaggagaagtcaacaaaatcaaatctgcacttctatccacaaacaaagctgtagtatccctatccggatgcggagtctcagtattaacttttaaagtactagaccttaaaaactacatagataaacaactattaccaatactaaataaacaatcatgcagcatatccaatatagagacagtaattgaatttcaacaaaaaaacaacagattactagaaattactcgtgaattttccgtaaatgccggagtcacaacaccagtatcaacctatatgctaacaaacagcgaactacttagcttaataaatgacatgccaataacaaatgaccaaaaaaaacttatgtcaaataacgtacaaatcgtcagacaacaatcctactctataatgtgtataattaaagaagaagtcctagcatacgtagttcaattaccactctatggagtaatagatacaccatgctggaaactacacacgtcaccactatgtacaacaaacacaaaagaaggatccaatatatgcctaacaagaaccgacagaggctggtattgtgacaacgcaggatccgtttcattcttcccacaagcagaaacctgtaaagtacaatctaatagagtattttgcgacacaatgaacagtagaacactaccaagcgaggttaatctatgtaacgtagacatattcaatccaaaatatgattgcaaaataatgacatcaaaaacagatgtatcgtcgagtgtaataacaagtctgggagctatagtaagctgctacggcaagacgaaatgtaccgcttcaaataaatgcagaggaatcattaaaacattctcgaacggatgcgactacgtaagtaataaaggtgtcgacaccgtatcagtagggaatacattatactacgtcaacaaacaagaaggaaaatctctatatgtaaaaggagaaccaataataaatttctatgaccctctagtattcccatcagatgaatttgacgcttccatatcacaagtaaacgaaaaaatcaatcaatctttagcattcatacgaaaaagtgatgaactcctacacaacgtcaacgcaggaaaaagcacaacaaatataatgatcacaacaatcatcatagtaataatagtaatactactatcattaatagcagtaggattattgctttactgcaaagcacgatagggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5839 - RNA, 1901 nt, synthetic construct
  misc_feature 1..1901: note = mRNA product Design d-2 comprising derived and/or modified sequence from HRSV(A2)__F-del_DSCav1_mut5 (opt11)
  source 1..1901: mol_type = other RNA
gggagagcggctcggccattttgtcccagtcagtccggaggctgcggctgcagaagtaccgcctgcggagtaactgcaaagaagcttaccatggaactcctcatcctcaaagccaacgccataaccacaatactcaccgccgtaaccttctgctttgcgtcgggacaaaacatcaccgaagagttctaccaatccacttgctccgcagtaagcaaaggatacctctccgccctgcgaaccggttggtacacatcagtcatcacaatcgaactctcaaacataaaagaaaacaaatgcaacggcaccgacgcaaaggtcaaattaatcaagcaagaactagacaaatacaaaaacgccgtcacagaactccagctgctaatgcagagcacacccgcaactggcagcggatccgccatcgcatcaggagtcgccgtgtgcaaagtcctacacctcgaaggagaagtgaacaaaatcaaatcagccctactctccaccaacaaggccgtcgtctccctctccggctgcggtgtctccgtcctaaccttcaaagtgctagacctcaagaactacatcgacaaacaactcctaccaatactcaacaagcaatcttgctccatctccaacatcgaaaccgtaatcgagttccaacagaagaacaaccgcctcctcgaaatcacccgcgagttctctgtcaacgcaggggtcaccactcccgtctccacatacatgctcacaaactccgaactcctcagcctcatcaacgacatgcccataaccaacgaccagaaaaagctaatgagcaataacgtccaaatcgttagacaacaaagttattccatcatgtgcatcatcaaagaagaagtcctcgcctacgtcgtacaactccccctctatggcgtcatcgacaccccctgctggaaactgcacacatcacccctctgcaccacaaacaccaaagaaggctcaaacatctgcctaactcgcaccgaccgcggctggtactgcgacaacgccggcagcgtatcattctttccccaagccgaaacatgcaaagttcaatccaaccgcgtcttctgcgacacaatgaactccagaacgctccccagcgaagtcaacctctgtaacgtagacatcttcaaccctaagtacgactgcaaaatcatgacctccaaaactgatgtatcctcctccgtcatcacatccctgggcgccatcgtcagctgctacggcaaaacaaaatgcactgcctcaaacaaatgccgaggtatcataaagaccttctcaaacggatgcgattacgtcagcaacaaaggcgtcgacaccgtcagtgtcggcaacaccctctactacgtcaacaaacaagaaggaaaatccctctacgtcaaaggcgaacccatcatcaacttctacgaccccctcgtcttccccagcgacgagttcgacgcctccatctcacaagtcaacgaaaagataaaccaatctctagccttcatccgcaaatccgatgaactcctgcataacgtcaacgccggcaaatccaccacaaacatcatgatcactaccataatcatcgtcataatcgtaatcctcctatctcttatcgcagtcggcctactactctactgcaaagcccgctaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5840 - RNA, 2217 nt, synthetic construct
  misc_feature 1..2217: note = mRNA product Design d-3 comprising derived and/or modified sequence from HRSV(A2)__F-del_DSCav1_mut5 (opt1)
  source 1..2217: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5841 - RNA, 2217 nt, synthetic construct
  misc_feature 1..2217: note = mRNA product Design d-3 comprising derived and/or modified sequence from HRSV(A2)__F-del_DSCav1_mut5 (opt1)
  source 1..2217: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcgggtgcggcgtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggggtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggcgtgatcgacacgccgtgctggaagctgcacaccagccccctctgcaccaccaacacgaaggaggggtccaacatctgcctgacccgcaccgaccggggctggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggggccatcgtgtcctgctacggcaagaccaagtgcaccgccagcaacaagtgccgggggatcatcaagaccttctccaacggctgcgactacgtgagcaacaagggcgtcgacacggtgagcgtggggaacaccctctactacgtcaacaagcaggagggcaagtccctgtacgtgaagggggagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccggcaagtccaccaccaacatcatgatcaccacgatcatcatcgtgatcatcgtcatcctcctgagcctgatcgccgtggggctcctgctgtactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5842 - RNA, 2217 nt, synthetic construct
  misc_feature 1..2217: note = mRNA product Design d-3 comprising derived and/or modified sequence from HRSV(A2)__F-del_DSCav1_mut5 (opt2)
  source 1..2217: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5843 - RNA, 2217 nt, synthetic construct
  misc_feature 1..2217: note = mRNA product Design d-3 comprising derived and/or modified sequence from HRSV(A2)__F-del_DSCav1_mut5 (opt3)
  source 1..2217: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcggttgcggggtgtccgtattaacttttaaggttctggaccttaagaactacattgataaacaattgctgcctatcctaaataagcagtcatgtagtattagcaacatcgagaccgtgatagagttccagcagaaaaataacaggctcctggaaattacacgggagttttctgtcaatgcgggagtgactaccccagtgtccacatatatgcttaccaactcagaactgttgagcctcatcaatgacatgccgattacgaacgatcaaaagaaactgatgagtaacaatgtccagatcgttcgccagcagtcttactccatcatgtgcattataaaggaggaagtgttagcatatgtagtgcaactgcccctctacggcgtcatcgacactccttgttggaaacttcatacaagcccactgtgcaccactaacacaaaggagggctcgaatatttgtttgacccgaacggatcgtgggtggtactgcgacaacgccggatctgtgtccttctttccccaggctgaaacctgtaaggttcagtcaaatagagtgttctgcgatacaatgaacagtagaactctgcctagcgaggtcaatctctgcaacgtggacatctttaatccaaaatatgattgtaagataatgacctccaaaacagacgtatctagctcagttattaccagtctgggtgccatcgtgtcctgctacggcaagactaaatgtacagcaagcaacaagtgcagggggatcattaagaccttctctaatggatgtgattatgtctcaaacaaaggcgtggacactgtcagtgtgggtaatacgctttactatgttaacaagcaagaggggaaaagcctgtacgtgaagggagaacccatcattaatttttatgaccctttggtattcccatccgatgagtttgacgcttctatatcgcaggtcaacgagaaaatcaaccagagcctcgccttcattcggaagtccgatgaactgttacacaatgtgaacgcgggcaagtcaacaaccaatatcatgatcactaccattataatcgttattatcgtgattctgctaagtctcatcgccgtcggcctgcttttgtactgcaaagcacgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5844 - RNA, 2217 nt, synthetic construct
  misc_feature 1..2217: note = mRNA product Design d-3 comprising derived and/or modified sequence from HRSV(A2)__F-del_DSCav1_mut5 (opt4)
  source 1..2217: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5845 - RNA, 2217 nt, synthetic construct
  misc_feature 1..2217: note = mRNA product Design d-3 comprising derived and/or modified sequence from HRSV(A2)__F-del_DSCav1_mut5 (opt5)
  source 1..2217: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcggatgcggcgtttctgtgctgacatttaaggtccttgacctgaagaactacattgataaacaactcctgcctatcctgaataagcagtcctgtagcatttctaacatcgagaccgtgattgagttccagcagaaaaataaccggctcctggaaatcacgcgcgagttttccgtgaatgccggcgtcacaaccccggttagcacatatatgcttaccaactccgaactgctctctctgatcaatgacatgcccattaccaacgatcaaaagaaacttatgagcaacaatgtgcagatcgtgagacagcagtcctacagcattatgtgcatcattaaggaggaagtcctggcttatgtggttcaactccctctgtacggggtgatcgacacaccctgttggaaactgcatacgtctcctctctgcaccacaaacaccaaggagggatccaatatctgtctgacacggaccgatcgcggctggtactgcgacaacgccgggagcgtctctttctttccccaggcggaaacgtgtaaggtgcagagcaatagagttttctgcgatacaatgaactccagaaccctgccttctgaggtgaatctctgcaacgtcgacatttttaatccgaaatatgattgtaagatcatgaccagcaaaacagacgtgtccagctctgtcattacctccctgggagccatcgtgagctgctacggcaagacaaaatgtacggcttctaacaagtgccgggggattatcaagaccttctccaatggatgtgattatgttagcaacaaaggcgtggacacagtctccgtgggcaataccctttactatgttaacaagcaagaggggaaatctctgtacgtgaagggagaacccatcattaatttttatgaccctctcgtcttccccagcgatgagtttgacgcctccatctctcaggtgaacgagaaaattaaccagagcctggctttcatccgcaagtccgatgaactgctccacaatgtgaacgccggcaagagcacaaccaatattatgatcacgaccattatcatcgttattatcgtcattctgctttctctgatcgccgtggggctcctgctgtactgcaaagctagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5846 - RNA, 2217 nt, synthetic construct
  misc_feature 1..2217: note = mRNA product Design d-3 comprising derived and/or modified sequence from HRSV(A2)__F-del_DSCav1_mut5 (opt6)
  source 1..2217: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaacttttaatactgaaagcaaatgccatcacaaccatactaactgccgtcacattctgctttgcatcaggacaaaacataacagaagaattttaccaatccacatgctcagcagtatcaaaaggatatctatcggcacttagaactggatggtacacaagtgttataactatagaactctcaaacataaaagaaaacaaatgcaatggaacagacgcaaaagtaaaactaataaaacaagaactcgataaatataaaaatgcagtaaccgaactacaactattaatgcaaagcacacccgcaacaggcagcggatcagcaatagcaagcggagtcgcagtatgtaaagtactacatctagaaggagaagtcaacaaaatcaaatctgcacttctatccacaaacaaagctgtagtatccctatccggatgcggagtctcagtattaacttttaaagtactagaccttaaaaactacatagataaacaactattaccaatactaaataaacaatcatgcagcatatccaatatagagacagtaattgaatttcaacaaaaaaacaacagattactagaaattactcgtgaattttccgtaaatgccggagtcacaacaccagtatcaacctatatgctaacaaacagcgaactacttagcttaataaatgacatgccaataacaaatgaccaaaaaaaacttatgtcaaataacgtacaaatcgtcagacaacaatcctactctataatgtgtataattaaagaagaagtcctagcatacgtagttcaattaccactctatggagtaatagatacaccatgctggaaactacacacgtcaccactatgtacaacaaacacaaaagaaggatccaatatatgcctaacaagaaccgacagaggctggtattgtgacaacgcaggatccgtttcattcttcccacaagcagaaacctgtaaagtacaatctaatagagtattttgcgacacaatgaacagtagaacactaccaagcgaggttaatctatgtaacgtagacatattcaatccaaaatatgattgcaaaataatgacatcaaaaacagatgtatcgtcgagtgtaataacaagtctgggagctatagtaagctgctacggcaagacgaaatgtaccgcttcaaataaatgcagaggaatcattaaaacattctcgaacggatgcgactacgtaagtaataaaggtgtcgacaccgtatcagtagggaatacattatactacgtcaacaaacaagaaggaaaatctctatatgtaaaaggagaaccaataataaatttctatgaccctctagtattcccatcagatgaatttgacgcttccatatcacaagtaaacgaaaaaatcaatcaatctttagcattcatacgaaaaagtgatgaactcctacacaacgtcaacgcaggaaaaagcacaacaaatataatgatcacaacaatcatcatagtaataatagtaatactactatcattaatagcagtaggattattgctttactgcaaagcacgatagggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5847 - RNA, 2217 nt, synthetic construct
  misc_feature 1..2217: note = mRNA product Design d-3 comprising derived and/or modified sequence from HRSV(A2)__F-del_DSCav1_mut5 (opt11)
  source 1..2217: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcctcatcctcaaagccaacgccataaccacaatactcaccgccgtaaccttctgctttgcgtcgggacaaaacatcaccgaagagttctaccaatccacttgctccgcagtaagcaaaggatacctctccgccctgcgaaccggttggtacacatcagtcatcacaatcgaactctcaaacataaaagaaaacaaatgcaacggcaccgacgcaaaggtcaaattaatcaagcaagaactagacaaatacaaaaacgccgtcacagaactccagctgctaatgcagagcacacccgcaactggcagcggatccgccatcgcatcaggagtcgccgtgtgcaaagtcctacacctcgaaggagaagtgaacaaaatcaaatcagccctactctccaccaacaaggccgtcgtctccctctccggctgcggtgtctccgtcctaaccttcaaagtgctagacctcaagaactacatcgacaaacaactcctaccaatactcaacaagcaatcttgctccatctccaacatcgaaaccgtaatcgagttccaacagaagaacaaccgcctcctcgaaatcacccgcgagttctctgtcaacgcaggggtcaccactcccgtctccacatacatgctcacaaactccgaactcctcagcctcatcaacgacatgcccataaccaacgaccagaaaaagctaatgagcaataacgtccaaatcgttagacaacaaagttattccatcatgtgcatcatcaaagaagaagtcctcgcctacgtcgtacaactccccctctatggcgtcatcgacaccccctgctggaaactgcacacatcacccctctgcaccacaaacaccaaagaaggctcaaacatctgcctaactcgcaccgaccgcggctggtactgcgacaacgccggcagcgtatcattctttccccaagccgaaacatgcaaagttcaatccaaccgcgtcttctgcgacacaatgaactccagaacgctccccagcgaagtcaacctctgtaacgtagacatcttcaaccctaagtacgactgcaaaatcatgacctccaaaactgatgtatcctcctccgtcatcacatccctgggcgccatcgtcagctgctacggcaaaacaaaatgcactgcctcaaacaaatgccgaggtatcataaagaccttctcaaacggatgcgattacgtcagcaacaaaggcgtcgacaccgtcagtgtcggcaacaccctctactacgtcaacaaacaagaaggaaaatccctctacgtcaaaggcgaacccatcatcaacttctacgaccccctcgtcttccccagcgacgagttcgacgcctccatctcacaagtcaacgaaaagataaaccaatctctagccttcatccgcaaatccgatgaactcctgcataacgtcaacgccggcaaatccaccacaaacatcatgatcactaccataatcatcgtcataatcgtaatcctcctatctcttatcgcagtcggcctactactctactgcaaagcccgctaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5848 - RNA, 1900 nt, synthetic construct
  misc_feature 1..1900: note = mRNA product Design d-4 comprising derived and/or modified sequence from HRSV(A2)__F-del_DSCav1_mut5 (opt1)
  source 1..1900: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5849 - RNA, 1900 nt, synthetic construct
  misc_feature 1..1900: note = mRNA product Design d-4 comprising derived and/or modified sequence from HRSV(A2)__F-del_DSCav1_mut5 (opt1)
  source 1..1900: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcgggtgcggcgtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggggtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggcgtgatcgacacgccgtgctggaagctgcacaccagccccctctgcaccaccaacacgaaggaggggtccaacatctgcctgacccgcaccgaccggggctggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggggccatcgtgtcctgctacggcaagaccaagtgcaccgccagcaacaagtgccgggggatcatcaagaccttctccaacggctgcgactacgtgagcaacaagggcgtcgacacggtgagcgtggggaacaccctctactacgtcaacaagcaggagggcaagtccctgtacgtgaagggggagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccggcaagtccaccaccaacatcatgatcaccacgatcatcatcgtgatcatcgtcatcctcctgagcctgatcgccgtggggctcctgctgtactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5850 - RNA, 1900 nt, synthetic construct
  misc_feature 1..1900: note = mRNA product Design d-4 comprising derived and/or modified sequence from HRSV(A2)__F-del_DSCav1_mut5 (opt2)
  source 1..1900: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5851 - RNA, 1900 nt, synthetic construct
  misc_feature 1..1900: note = mRNA product Design d-4 comprising derived and/or modified sequence from HRSV(A2)__F-del_DSCav1_mut5 (opt3)
  source 1..1900: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcggttgcggggtgtccgtattaacttttaaggttctggaccttaagaactacattgataaacaattgctgcctatcctaaataagcagtcatgtagtattagcaacatcgagaccgtgatagagttccagcagaaaaataacaggctcctggaaattacacgggagttttctgtcaatgcgggagtgactaccccagtgtccacatatatgcttaccaactcagaactgttgagcctcatcaatgacatgccgattacgaacgatcaaaagaaactgatgagtaacaatgtccagatcgttcgccagcagtcttactccatcatgtgcattataaaggaggaagtgttagcatatgtagtgcaactgcccctctacggcgtcatcgacactccttgttggaaacttcatacaagcccactgtgcaccactaacacaaaggagggctcgaatatttgtttgacccgaacggatcgtgggtggtactgcgacaacgccggatctgtgtccttctttccccaggctgaaacctgtaaggttcagtcaaatagagtgttctgcgatacaatgaacagtagaactctgcctagcgaggtcaatctctgcaacgtggacatctttaatccaaaatatgattgtaagataatgacctccaaaacagacgtatctagctcagttattaccagtctgggtgccatcgtgtcctgctacggcaagactaaatgtacagcaagcaacaagtgcagggggatcattaagaccttctctaatggatgtgattatgtctcaaacaaaggcgtggacactgtcagtgtgggtaatacgctttactatgttaacaagcaagaggggaaaagcctgtacgtgaagggagaacccatcattaatttttatgaccctttggtattcccatccgatgagtttgacgcttctatatcgcaggtcaacgagaaaatcaaccagagcctcgccttcattcggaagtccgatgaactgttacacaatgtgaacgcgggcaagtcaacaaccaatatcatgatcactaccattataatcgttattatcgtgattctgctaagtctcatcgccgtcggcctgcttttgtactgcaaagcacgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5852 - RNA, 1900 nt, synthetic construct
  misc_feature 1..1900: note = mRNA product Design d-4 comprising derived and/or modified sequence from HRSV(A2)__F-del_DSCav1_mut5 (opt4)
  source 1..1900: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5853 - RNA, 1900 nt, synthetic construct
  misc_feature 1..1900: note = mRNA product Design d-4 comprising derived and/or modified sequence from HRSV(A2)__F-del_DSCav1_mut5 (opt5)
  source 1..1900: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcggatgcggcgtttctgtgctgacatttaaggtccttgacctgaagaactacattgataaacaactcctgcctatcctgaataagcagtcctgtagcatttctaacatcgagaccgtgattgagttccagcagaaaaataaccggctcctggaaatcacgcgcgagttttccgtgaatgccggcgtcacaaccccggttagcacatatatgcttaccaactccgaactgctctctctgatcaatgacatgcccattaccaacgatcaaaagaaacttatgagcaacaatgtgcagatcgtgagacagcagtcctacagcattatgtgcatcattaaggaggaagtcctggcttatgtggttcaactccctctgtacggggtgatcgacacaccctgttggaaactgcatacgtctcctctctgcaccacaaacaccaaggagggatccaatatctgtctgacacggaccgatcgcggctggtactgcgacaacgccgggagcgtctctttctttccccaggcggaaacgtgtaaggtgcagagcaatagagttttctgcgatacaatgaactccagaaccctgccttctgaggtgaatctctgcaacgtcgacatttttaatccgaaatatgattgtaagatcatgaccagcaaaacagacgtgtccagctctgtcattacctccctgggagccatcgtgagctgctacggcaagacaaaatgtacggcttctaacaagtgccgggggattatcaagaccttctccaatggatgtgattatgttagcaacaaaggcgtggacacagtctccgtgggcaataccctttactatgttaacaagcaagaggggaaatctctgtacgtgaagggagaacccatcattaatttttatgaccctctcgtcttccccagcgatgagtttgacgcctccatctctcaggtgaacgagaaaattaaccagagcctggctttcatccgcaagtccgatgaactgctccacaatgtgaacgccggcaagagcacaaccaatattatgatcacgaccattatcatcgttattatcgtcattctgctttctctgatcgccgtggggctcctgctgtactgcaaagctagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5854 - RNA, 1900 nt, synthetic construct
  misc_feature 1..1900: note = mRNA product Design d-4 comprising derived and/or modified sequence from HRSV(A2)__F-del_DSCav1_mut5 (opt6)
  source 1..1900: mol_type = other RNA
gggagagtcccgcagtcggcgtccagcggctctgcttgttcgtgtgtgtgtcgttgcaggccttattcaagcttaccatggaacttttaatactgaaagcaaatgccatcacaaccatactaactgccgtcacattctgctttgcatcaggacaaaacataacagaagaattttaccaatccacatgctcagcagtatcaaaaggatatctatcggcacttagaactggatggtacacaagtgttataactatagaactctcaaacataaaagaaaacaaatgcaatggaacagacgcaaaagtaaaactaataaaacaagaactcgataaatataaaaatgcagtaaccgaactacaactattaatgcaaagcacacccgcaacaggcagcggatcagcaatagcaagcggagtcgcagtatgtaaagtactacatctagaaggagaagtcaacaaaatcaaatctgcacttctatccacaaacaaagctgtagtatccctatccggatgcggagtctcagtattaacttttaaagtactagaccttaaaaactacatagataaacaactattaccaatactaaataaacaatcatgcagcatatccaatatagagacagtaattgaatttcaacaaaaaaacaacagattactagaaattactcgtgaattttccgtaaatgccggagtcacaacaccagtatcaacctatatgctaacaaacagcgaactacttagcttaataaatgacatgccaataacaaatgaccaaaaaaaacttatgtcaaataacgtacaaatcgtcagacaacaatcctactctataatgtgtataattaaagaagaagtcctagcatacgtagttcaattaccactctatggagtaatagatacaccatgctggaaactacacacgtcaccactatgtacaacaaacacaaaagaaggatccaatatatgcctaacaagaaccgacagaggctggtattgtgacaacgcaggatccgtttcattcttcccacaagcagaaacctgtaaagtacaatctaatagagtattttgcgacacaatgaacagtagaacactaccaagcgaggttaatctatgtaacgtagacatattcaatccaaaatatgattgcaaaataatgacatcaaaaacagatgtatcgtcgagtgtaataacaagtctgggagctatagtaagctgctacggcaagacgaaatgtaccgcttcaaataaatgcagaggaatcattaaaacattctcgaacggatgcgactacgtaagtaataaaggtgtcgacaccgtatcagtagggaatacattatactacgtcaacaaacaagaaggaaaatctctatatgtaaaaggagaaccaataataaatttctatgaccctctagtattcccatcagatgaatttgacgcttccatatcacaagtaaacgaaaaaatcaatcaatctttagcattcatacgaaaaagtgatgaactcctacacaacgtcaacgcaggaaaaagcacaacaaatataatgatcacaacaatcatcatagtaataatagtaatactactatcattaatagcagtaggattattgctttactgcaaagcacgatagggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5855 - RNA, 1900 nt, synthetic construct
  misc_feature 1..1900: note = mRNA product Design d-4 comprising derived and/or modified sequence from HRSV(A2)__F-del_DSCav1_mut5 (opt11)
  source 1..1900: mol_type = other RNA
gggagagtcccgcagtcggcgtccagcggctctgcttgttcgtgtgtgtgtcgttgcaggccttattcaagcttaccatggaactcctcatcctcaaagccaacgccataaccacaatactcaccgccgtaaccttctgctttgcgtcgggacaaaacatcaccgaagagttctaccaatccacttgctccgcagtaagcaaaggatacctctccgccctgcgaaccggttggtacacatcagtcatcacaatcgaactctcaaacataaaagaaaacaaatgcaacggcaccgacgcaaaggtcaaattaatcaagcaagaactagacaaatacaaaaacgccgtcacagaactccagctgctaatgcagagcacacccgcaactggcagcggatccgccatcgcatcaggagtcgccgtgtgcaaagtcctacacctcgaaggagaagtgaacaaaatcaaatcagccctactctccaccaacaaggccgtcgtctccctctccggctgcggtgtctccgtcctaaccttcaaagtgctagacctcaagaactacatcgacaaacaactcctaccaatactcaacaagcaatcttgctccatctccaacatcgaaaccgtaatcgagttccaacagaagaacaaccgcctcctcgaaatcacccgcgagttctctgtcaacgcaggggtcaccactcccgtctccacatacatgctcacaaactccgaactcctcagcctcatcaacgacatgcccataaccaacgaccagaaaaagctaatgagcaataacgtccaaatcgttagacaacaaagttattccatcatgtgcatcatcaaagaagaagtcctcgcctacgtcgtacaactccccctctatggcgtcatcgacaccccctgctggaaactgcacacatcacccctctgcaccacaaacaccaaagaaggctcaaacatctgcctaactcgcaccgaccgcggctggtactgcgacaacgccggcagcgtatcattctttccccaagccgaaacatgcaaagttcaatccaaccgcgtcttctgcgacacaatgaactccagaacgctccccagcgaagtcaacctctgtaacgtagacatcttcaaccctaagtacgactgcaaaatcatgacctccaaaactgatgtatcctcctccgtcatcacatccctgggcgccatcgtcagctgctacggcaaaacaaaatgcactgcctcaaacaaatgccgaggtatcataaagaccttctcaaacggatgcgattacgtcagcaacaaaggcgtcgacaccgtcagtgtcggcaacaccctctactacgtcaacaaacaagaaggaaaatccctctacgtcaaaggcgaacccatcatcaacttctacgaccccctcgtcttccccagcgacgagttcgacgcctccatctcacaagtcaacgaaaagataaaccaatctctagccttcatccgcaaatccgatgaactcctgcataacgtcaacgccggcaaatccaccacaaacatcatgatcactaccataatcatcgtcataatcgtaatcctcctatctcttatcgcagtcggcctactactctactgcaaagcccgctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5856 - RNA, 1997 nt, synthetic construct
  misc_feature 1..1997: note = mRNA product Design d-5 comprising derived and/or modified sequence from HRSV(A2)__F-del_DSCav1_mut5 (opt1)
  source 1..1997: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5857 - RNA, 1997 nt, synthetic construct
  misc_feature 1..1997: note = mRNA product Design d-5 comprising derived and/or modified sequence from HRSV(A2)__F-del_DSCav1_mut5 (opt1)
  source 1..1997: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcgggtgcggcgtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggggtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggcgtgatcgacacgccgtgctggaagctgcacaccagccccctctgcaccaccaacacgaaggaggggtccaacatctgcctgacccgcaccgaccggggctggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggggccatcgtgtcctgctacggcaagaccaagtgcaccgccagcaacaagtgccgggggatcatcaagaccttctccaacggctgcgactacgtgagcaacaagggcgtcgacacggtgagcgtggggaacaccctctactacgtcaacaagcaggagggcaagtccctgtacgtgaagggggagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccggcaagtccaccaccaacatcatgatcaccacgatcatcatcgtgatcatcgtcatcctcctgagcctgatcgccgtggggctcctgctgtactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5858 - RNA, 1997 nt, synthetic construct
  misc_feature 1..1997: note = mRNA product Design d-5 comprising derived and/or modified sequence from HRSV(A2)__F-del_DSCav1_mut5 (opt2)
  source 1..1997: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5859 - RNA, 1997 nt, synthetic construct
  misc_feature 1..1997: note = mRNA product Design d-5 comprising derived and/or modified sequence from HRSV(A2)__F-del_DSCav1_mut5 (opt3)
  source 1..1997: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcggttgcggggtgtccgtattaacttttaaggttctggaccttaagaactacattgataaacaattgctgcctatcctaaataagcagtcatgtagtattagcaacatcgagaccgtgatagagttccagcagaaaaataacaggctcctggaaattacacgggagttttctgtcaatgcgggagtgactaccccagtgtccacatatatgcttaccaactcagaactgttgagcctcatcaatgacatgccgattacgaacgatcaaaagaaactgatgagtaacaatgtccagatcgttcgccagcagtcttactccatcatgtgcattataaaggaggaagtgttagcatatgtagtgcaactgcccctctacggcgtcatcgacactccttgttggaaacttcatacaagcccactgtgcaccactaacacaaaggagggctcgaatatttgtttgacccgaacggatcgtgggtggtactgcgacaacgccggatctgtgtccttctttccccaggctgaaacctgtaaggttcagtcaaatagagtgttctgcgatacaatgaacagtagaactctgcctagcgaggtcaatctctgcaacgtggacatctttaatccaaaatatgattgtaagataatgacctccaaaacagacgtatctagctcagttattaccagtctgggtgccatcgtgtcctgctacggcaagactaaatgtacagcaagcaacaagtgcagggggatcattaagaccttctctaatggatgtgattatgtctcaaacaaaggcgtggacactgtcagtgtgggtaatacgctttactatgttaacaagcaagaggggaaaagcctgtacgtgaagggagaacccatcattaatttttatgaccctttggtattcccatccgatgagtttgacgcttctatatcgcaggtcaacgagaaaatcaaccagagcctcgccttcattcggaagtccgatgaactgttacacaatgtgaacgcgggcaagtcaacaaccaatatcatgatcactaccattataatcgttattatcgtgattctgctaagtctcatcgccgtcggcctgcttttgtactgcaaagcacgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5860 - RNA, 1997 nt, synthetic construct
  misc_feature 1..1997: note = mRNA product Design d-5 comprising derived and/or modified sequence from HRSV(A2)__F-del_DSCav1_mut5 (opt4)
  source 1..1997: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5861 - RNA, 1997 nt, synthetic construct
  misc_feature 1..1997: note = mRNA product Design d-5 comprising derived and/or modified sequence from HRSV(A2)__F-del_DSCav1_mut5 (opt5)
  source 1..1997: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcggatgcggcgtttctgtgctgacatttaaggtccttgacctgaagaactacattgataaacaactcctgcctatcctgaataagcagtcctgtagcatttctaacatcgagaccgtgattgagttccagcagaaaaataaccggctcctggaaatcacgcgcgagttttccgtgaatgccggcgtcacaaccccggttagcacatatatgcttaccaactccgaactgctctctctgatcaatgacatgcccattaccaacgatcaaaagaaacttatgagcaacaatgtgcagatcgtgagacagcagtcctacagcattatgtgcatcattaaggaggaagtcctggcttatgtggttcaactccctctgtacggggtgatcgacacaccctgttggaaactgcatacgtctcctctctgcaccacaaacaccaaggagggatccaatatctgtctgacacggaccgatcgcggctggtactgcgacaacgccgggagcgtctctttctttccccaggcggaaacgtgtaaggtgcagagcaatagagttttctgcgatacaatgaactccagaaccctgccttctgaggtgaatctctgcaacgtcgacatttttaatccgaaatatgattgtaagatcatgaccagcaaaacagacgtgtccagctctgtcattacctccctgggagccatcgtgagctgctacggcaagacaaaatgtacggcttctaacaagtgccgggggattatcaagaccttctccaatggatgtgattatgttagcaacaaaggcgtggacacagtctccgtgggcaataccctttactatgttaacaagcaagaggggaaatctctgtacgtgaagggagaacccatcattaatttttatgaccctctcgtcttccccagcgatgagtttgacgcctccatctctcaggtgaacgagaaaattaaccagagcctggctttcatccgcaagtccgatgaactgctccacaatgtgaacgccggcaagagcacaaccaatattatgatcacgaccattatcatcgttattatcgtcattctgctttctctgatcgccgtggggctcctgctgtactgcaaagctagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5862 - RNA, 1997 nt, synthetic construct
  misc_feature 1..1997: note = mRNA product Design d-5 comprising derived and/or modified sequence from HRSV(A2)__F-del_DSCav1_mut5 (opt6)
  source 1..1997: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaacttttaatactgaaagcaaatgccatcacaaccatactaactgccgtcacattctgctttgcatcaggacaaaacataacagaagaattttaccaatccacatgctcagcagtatcaaaaggatatctatcggcacttagaactggatggtacacaagtgttataactatagaactctcaaacataaaagaaaacaaatgcaatggaacagacgcaaaagtaaaactaataaaacaagaactcgataaatataaaaatgcagtaaccgaactacaactattaatgcaaagcacacccgcaacaggcagcggatcagcaatagcaagcggagtcgcagtatgtaaagtactacatctagaaggagaagtcaacaaaatcaaatctgcacttctatccacaaacaaagctgtagtatccctatccggatgcggagtctcagtattaacttttaaagtactagaccttaaaaactacatagataaacaactattaccaatactaaataaacaatcatgcagcatatccaatatagagacagtaattgaatttcaacaaaaaaacaacagattactagaaattactcgtgaattttccgtaaatgccggagtcacaacaccagtatcaacctatatgctaacaaacagcgaactacttagcttaataaatgacatgccaataacaaatgaccaaaaaaaacttatgtcaaataacgtacaaatcgtcagacaacaatcctactctataatgtgtataattaaagaagaagtcctagcatacgtagttcaattaccactctatggagtaatagatacaccatgctggaaactacacacgtcaccactatgtacaacaaacacaaaagaaggatccaatatatgcctaacaagaaccgacagaggctggtattgtgacaacgcaggatccgtttcattcttcccacaagcagaaacctgtaaagtacaatctaatagagtattttgcgacacaatgaacagtagaacactaccaagcgaggttaatctatgtaacgtagacatattcaatccaaaatatgattgcaaaataatgacatcaaaaacagatgtatcgtcgagtgtaataacaagtctgggagctatagtaagctgctacggcaagacgaaatgtaccgcttcaaataaatgcagaggaatcattaaaacattctcgaacggatgcgactacgtaagtaataaaggtgtcgacaccgtatcagtagggaatacattatactacgtcaacaaacaagaaggaaaatctctatatgtaaaaggagaaccaataataaatttctatgaccctctagtattcccatcagatgaatttgacgcttccatatcacaagtaaacgaaaaaatcaatcaatctttagcattcatacgaaaaagtgatgaactcctacacaacgtcaacgcaggaaaaagcacaacaaatataatgatcacaacaatcatcatagtaataatagtaatactactatcattaatagcagtaggattattgctttactgcaaagcacgatagggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5863 - RNA, 1997 nt, synthetic construct
  misc_feature 1..1997: note = mRNA product Design d-5 comprising derived and/or modified sequence from HRSV(A2)__F-del_DSCav1_mut5 (opt11)
  source 1..1997: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcctcatcctcaaagccaacgccataaccacaatactcaccgccgtaaccttctgctttgcgtcgggacaaaacatcaccgaagagttctaccaatccacttgctccgcagtaagcaaaggatacctctccgccctgcgaaccggttggtacacatcagtcatcacaatcgaactctcaaacataaaagaaaacaaatgcaacggcaccgacgcaaaggtcaaattaatcaagcaagaactagacaaatacaaaaacgccgtcacagaactccagctgctaatgcagagcacacccgcaactggcagcggatccgccatcgcatcaggagtcgccgtgtgcaaagtcctacacctcgaaggagaagtgaacaaaatcaaatcagccctactctccaccaacaaggccgtcgtctccctctccggctgcggtgtctccgtcctaaccttcaaagtgctagacctcaagaactacatcgacaaacaactcctaccaatactcaacaagcaatcttgctccatctccaacatcgaaaccgtaatcgagttccaacagaagaacaaccgcctcctcgaaatcacccgcgagttctctgtcaacgcaggggtcaccactcccgtctccacatacatgctcacaaactccgaactcctcagcctcatcaacgacatgcccataaccaacgaccagaaaaagctaatgagcaataacgtccaaatcgttagacaacaaagttattccatcatgtgcatcatcaaagaagaagtcctcgcctacgtcgtacaactccccctctatggcgtcatcgacaccccctgctggaaactgcacacatcacccctctgcaccacaaacaccaaagaaggctcaaacatctgcctaactcgcaccgaccgcggctggtactgcgacaacgccggcagcgtatcattctttccccaagccgaaacatgcaaagttcaatccaaccgcgtcttctgcgacacaatgaactccagaacgctccccagcgaagtcaacctctgtaacgtagacatcttcaaccctaagtacgactgcaaaatcatgacctccaaaactgatgtatcctcctccgtcatcacatccctgggcgccatcgtcagctgctacggcaaaacaaaatgcactgcctcaaacaaatgccgaggtatcataaagaccttctcaaacggatgcgattacgtcagcaacaaaggcgtcgacaccgtcagtgtcggcaacaccctctactacgtcaacaaacaagaaggaaaatccctctacgtcaaaggcgaacccatcatcaacttctacgaccccctcgtcttccccagcgacgagttcgacgcctccatctcacaagtcaacgaaaagataaaccaatctctagccttcatccgcaaatccgatgaactcctgcataacgtcaacgccggcaaatccaccacaaacatcatgatcactaccataatcatcgtcataatcgtaatcctcctatctcttatcgcagtcggcctactactctactgcaaagcccgctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5864 - RNA, 1877 nt, synthetic construct
  misc_feature 1..1877: note = mRNA product Design e-1 comprising derived and/or modified sequence from HRSV(A2)__F-del_DSCav1_mut5 (opt1)
  source 1..1877: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5865 - RNA, 1877 nt, synthetic construct
  misc_feature 1..1877: note = mRNA product Design e-1 comprising derived and/or modified sequence from HRSV(A2)__F-del_DSCav1_mut5 (opt1)
  source 1..1877: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcgggtgcggcgtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggggtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggcgtgatcgacacgccgtgctggaagctgcacaccagccccctctgcaccaccaacacgaaggaggggtccaacatctgcctgacccgcaccgaccggggctggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggggccatcgtgtcctgctacggcaagaccaagtgcaccgccagcaacaagtgccgggggatcatcaagaccttctccaacggctgcgactacgtgagcaacaagggcgtcgacacggtgagcgtggggaacaccctctactacgtcaacaagcaggagggcaagtccctgtacgtgaagggggagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccggcaagtccaccaccaacatcatgatcaccacgatcatcatcgtgatcatcgtcatcctcctgagcctgatcgccgtggggctcctgctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5866 - RNA, 1877 nt, synthetic construct
  misc_feature 1..1877: note = mRNA product Design e-1 comprising derived and/or modified sequence from HRSV(A2)__F-del_DSCav1_mut5 (opt2)
  source 1..1877: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5867 - RNA, 1877 nt, synthetic construct
  misc_feature 1..1877: note = mRNA product Design e-1 comprising derived and/or modified sequence from HRSV(A2)__F-del_DSCav1_mut5 (opt3)
  source 1..1877: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcggttgcggggtgtccgtattaacttttaaggttctggaccttaagaactacattgataaacaattgctgcctatcctaaataagcagtcatgtagtattagcaacatcgagaccgtgatagagttccagcagaaaaataacaggctcctggaaattacacgggagttttctgtcaatgcgggagtgactaccccagtgtccacatatatgcttaccaactcagaactgttgagcctcatcaatgacatgccgattacgaacgatcaaaagaaactgatgagtaacaatgtccagatcgttcgccagcagtcttactccatcatgtgcattataaaggaggaagtgttagcatatgtagtgcaactgcccctctacggcgtcatcgacactccttgttggaaacttcatacaagcccactgtgcaccactaacacaaaggagggctcgaatatttgtttgacccgaacggatcgtgggtggtactgcgacaacgccggatctgtgtccttctttccccaggctgaaacctgtaaggttcagtcaaatagagtgttctgcgatacaatgaacagtagaactctgcctagcgaggtcaatctctgcaacgtggacatctttaatccaaaatatgattgtaagataatgacctccaaaacagacgtatctagctcagttattaccagtctgggtgccatcgtgtcctgctacggcaagactaaatgtacagcaagcaacaagtgcagggggatcattaagaccttctctaatggatgtgattatgtctcaaacaaaggcgtggacactgtcagtgtgggtaatacgctttactatgttaacaagcaagaggggaaaagcctgtacgtgaagggagaacccatcattaatttttatgaccctttggtattcccatccgatgagtttgacgcttctatatcgcaggtcaacgagaaaatcaaccagagcctcgccttcattcggaagtccgatgaactgttacacaatgtgaacgcgggcaagtcaacaaccaatatcatgatcactaccattataatcgttattatcgtgattctgctaagtctcatcgccgtcggcctgcttttgtactgcaaagcacgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5868 - RNA, 1877 nt, synthetic construct
  misc_feature 1..1877: note = mRNA product Design e-1 comprising derived and/or modified sequence from HRSV(A2)__F-del_DSCav1_mut5 (opt4)
  source 1..1877: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5869 - RNA, 1877 nt, synthetic construct
  misc_feature 1..1877: note = mRNA product Design e-1 comprising derived and/or modified sequence from HRSV(A2)__F-del_DSCav1_mut5 (opt5)
  source 1..1877: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcggatgcggcgtttctgtgctgacatttaaggtccttgacctgaagaactacattgataaacaactcctgcctatcctgaataagcagtcctgtagcatttctaacatcgagaccgtgattgagttccagcagaaaaataaccggctcctggaaatcacgcgcgagttttccgtgaatgccggcgtcacaaccccggttagcacatatatgcttaccaactccgaactgctctctctgatcaatgacatgcccattaccaacgatcaaaagaaacttatgagcaacaatgtgcagatcgtgagacagcagtcctacagcattatgtgcatcattaaggaggaagtcctggcttatgtggttcaactccctctgtacggggtgatcgacacaccctgttggaaactgcatacgtctcctctctgcaccacaaacaccaaggagggatccaatatctgtctgacacggaccgatcgcggctggtactgcgacaacgccgggagcgtctctttctttccccaggcggaaacgtgtaaggtgcagagcaatagagttttctgcgatacaatgaactccagaaccctgccttctgaggtgaatctctgcaacgtcgacatttttaatccgaaatatgattgtaagatcatgaccagcaaaacagacgtgtccagctctgtcattacctccctgggagccatcgtgagctgctacggcaagacaaaatgtacggcttctaacaagtgccgggggattatcaagaccttctccaatggatgtgattatgttagcaacaaaggcgtggacacagtctccgtgggcaataccctttactatgttaacaagcaagaggggaaatctctgtacgtgaagggagaacccatcattaatttttatgaccctctcgtcttccccagcgatgagtttgacgcctccatctctcaggtgaacgagaaaattaaccagagcctggctttcatccgcaagtccgatgaactgctccacaatgtgaacgccggcaagagcacaaccaatattatgatcacgaccattatcatcgttattatcgtcattctgctttctctgatcgccgtggggctcctgctgtactgcaaagctagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5870 - RNA, 1877 nt, synthetic construct
  misc_feature 1..1877: note = mRNA product Design e-1 comprising derived and/or modified sequence from HRSV(A2)__F-del_DSCav1_mut5 (opt6)
  source 1..1877: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggaacttttaatactgaaagcaaatgccatcacaaccatactaactgccgtcacattctgctttgcatcaggacaaaacataacagaagaattttaccaatccacatgctcagcagtatcaaaaggatatctatcggcacttagaactggatggtacacaagtgttataactatagaactctcaaacataaaagaaaacaaatgcaatggaacagacgcaaaagtaaaactaataaaacaagaactcgataaatataaaaatgcagtaaccgaactacaactattaatgcaaagcacacccgcaacaggcagcggatcagcaatagcaagcggagtcgcagtatgtaaagtactacatctagaaggagaagtcaacaaaatcaaatctgcacttctatccacaaacaaagctgtagtatccctatccggatgcggagtctcagtattaacttttaaagtactagaccttaaaaactacatagataaacaactattaccaatactaaataaacaatcatgcagcatatccaatatagagacagtaattgaatttcaacaaaaaaacaacagattactagaaattactcgtgaattttccgtaaatgccggagtcacaacaccagtatcaacctatatgctaacaaacagcgaactacttagcttaataaatgacatgccaataacaaatgaccaaaaaaaacttatgtcaaataacgtacaaatcgtcagacaacaatcctactctataatgtgtataattaaagaagaagtcctagcatacgtagttcaattaccactctatggagtaatagatacaccatgctggaaactacacacgtcaccactatgtacaacaaacacaaaagaaggatccaatatatgcctaacaagaaccgacagaggctggtattgtgacaacgcaggatccgtttcattcttcccacaagcagaaacctgtaaagtacaatctaatagagtattttgcgacacaatgaacagtagaacactaccaagcgaggttaatctatgtaacgtagacatattcaatccaaaatatgattgcaaaataatgacatcaaaaacagatgtatcgtcgagtgtaataacaagtctgggagctatagtaagctgctacggcaagacgaaatgtaccgcttcaaataaatgcagaggaatcattaaaacattctcgaacggatgcgactacgtaagtaataaaggtgtcgacaccgtatcagtagggaatacattatactacgtcaacaaacaagaaggaaaatctctatatgtaaaaggagaaccaataataaatttctatgaccctctagtattcccatcagatgaatttgacgcttccatatcacaagtaaacgaaaaaatcaatcaatctttagcattcatacgaaaaagtgatgaactcctacacaacgtcaacgcaggaaaaagcacaacaaatataatgatcacaacaatcatcatagtaataatagtaatactactatcattaatagcagtaggattattgctttactgcaaagcacgatagggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5871 - RNA, 1877 nt, synthetic construct
  misc_feature 1..1877: note = mRNA product Design e-1 comprising derived and/or modified sequence from HRSV(A2)__F-del_DSCav1_mut5 (opt11)
  source 1..1877: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggaactcctcatcctcaaagccaacgccataaccacaatactcaccgccgtaaccttctgctttgcgtcgggacaaaacatcaccgaagagttctaccaatccacttgctccgcagtaagcaaaggatacctctccgccctgcgaaccggttggtacacatcagtcatcacaatcgaactctcaaacataaaagaaaacaaatgcaacggcaccgacgcaaaggtcaaattaatcaagcaagaactagacaaatacaaaaacgccgtcacagaactccagctgctaatgcagagcacacccgcaactggcagcggatccgccatcgcatcaggagtcgccgtgtgcaaagtcctacacctcgaaggagaagtgaacaaaatcaaatcagccctactctccaccaacaaggccgtcgtctccctctccggctgcggtgtctccgtcctaaccttcaaagtgctagacctcaagaactacatcgacaaacaactcctaccaatactcaacaagcaatcttgctccatctccaacatcgaaaccgtaatcgagttccaacagaagaacaaccgcctcctcgaaatcacccgcgagttctctgtcaacgcaggggtcaccactcccgtctccacatacatgctcacaaactccgaactcctcagcctcatcaacgacatgcccataaccaacgaccagaaaaagctaatgagcaataacgtccaaatcgttagacaacaaagttattccatcatgtgcatcatcaaagaagaagtcctcgcctacgtcgtacaactccccctctatggcgtcatcgacaccccctgctggaaactgcacacatcacccctctgcaccacaaacaccaaagaaggctcaaacatctgcctaactcgcaccgaccgcggctggtactgcgacaacgccggcagcgtatcattctttccccaagccgaaacatgcaaagttcaatccaaccgcgtcttctgcgacacaatgaactccagaacgctccccagcgaagtcaacctctgtaacgtagacatcttcaaccctaagtacgactgcaaaatcatgacctccaaaactgatgtatcctcctccgtcatcacatccctgggcgccatcgtcagctgctacggcaaaacaaaatgcactgcctcaaacaaatgccgaggtatcataaagaccttctcaaacggatgcgattacgtcagcaacaaaggcgtcgacaccgtcagtgtcggcaacaccctctactacgtcaacaaacaagaaggaaaatccctctacgtcaaaggcgaacccatcatcaacttctacgaccccctcgtcttccccagcgacgagttcgacgcctccatctcacaagtcaacgaaaagataaaccaatctctagccttcatccgcaaatccgatgaactcctgcataacgtcaacgccggcaaatccaccacaaacatcatgatcactaccataatcatcgtcataatcgtaatcctcctatctcttatcgcagtcggcctactactctactgcaaagcccgctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5872 - RNA, 1859 nt, synthetic construct
  misc_feature 1..1859: note = mRNA product Design e-2 comprising derived and/or modified sequence from HRSV(A2)__F-del_DSCav1_mut5 (opt1)
  source 1..1859: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5873 - RNA, 1859 nt, synthetic construct
  misc_feature 1..1859: note = mRNA product Design e-2 comprising derived and/or modified sequence from HRSV(A2)__F-del_DSCav1_mut5 (opt1)
  source 1..1859: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcgggtgcggcgtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggggtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggcgtgatcgacacgccgtgctggaagctgcacaccagccccctctgcaccaccaacacgaaggaggggtccaacatctgcctgacccgcaccgaccggggctggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggggccatcgtgtcctgctacggcaagaccaagtgcaccgccagcaacaagtgccgggggatcatcaagaccttctccaacggctgcgactacgtgagcaacaagggcgtcgacacggtgagcgtggggaacaccctctactacgtcaacaagcaggagggcaagtccctgtacgtgaagggggagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccggcaagtccaccaccaacatcatgatcaccacgatcatcatcgtgatcatcgtcatcctcctgagcctgatcgccgtggggctcctgctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5874 - RNA, 1859 nt, synthetic construct
  misc_feature 1..1859: note = mRNA product Design e-2 comprising derived and/or modified sequence from HRSV(A2)__F-del_DSCav1_mut5 (opt2)
  source 1..1859: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5875 - RNA, 1859 nt, synthetic construct
  misc_feature 1..1859: note = mRNA product Design e-2 comprising derived and/or modified sequence from HRSV(A2)__F-del_DSCav1_mut5 (opt3)
  source 1..1859: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcggttgcggggtgtccgtattaacttttaaggttctggaccttaagaactacattgataaacaattgctgcctatcctaaataagcagtcatgtagtattagcaacatcgagaccgtgatagagttccagcagaaaaataacaggctcctggaaattacacgggagttttctgtcaatgcgggagtgactaccccagtgtccacatatatgcttaccaactcagaactgttgagcctcatcaatgacatgccgattacgaacgatcaaaagaaactgatgagtaacaatgtccagatcgttcgccagcagtcttactccatcatgtgcattataaaggaggaagtgttagcatatgtagtgcaactgcccctctacggcgtcatcgacactccttgttggaaacttcatacaagcccactgtgcaccactaacacaaaggagggctcgaatatttgtttgacccgaacggatcgtgggtggtactgcgacaacgccggatctgtgtccttctttccccaggctgaaacctgtaaggttcagtcaaatagagtgttctgcgatacaatgaacagtagaactctgcctagcgaggtcaatctctgcaacgtggacatctttaatccaaaatatgattgtaagataatgacctccaaaacagacgtatctagctcagttattaccagtctgggtgccatcgtgtcctgctacggcaagactaaatgtacagcaagcaacaagtgcagggggatcattaagaccttctctaatggatgtgattatgtctcaaacaaaggcgtggacactgtcagtgtgggtaatacgctttactatgttaacaagcaagaggggaaaagcctgtacgtgaagggagaacccatcattaatttttatgaccctttggtattcccatccgatgagtttgacgcttctatatcgcaggtcaacgagaaaatcaaccagagcctcgccttcattcggaagtccgatgaactgttacacaatgtgaacgcgggcaagtcaacaaccaatatcatgatcactaccattataatcgttattatcgtgattctgctaagtctcatcgccgtcggcctgcttttgtactgcaaagcacgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5876 - RNA, 1859 nt, synthetic construct
  misc_feature 1..1859: note = mRNA product Design e-2 comprising derived and/or modified sequence from HRSV(A2)__F-del_DSCav1_mut5 (opt4)
  source 1..1859: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5877 - RNA, 1859 nt, synthetic construct
  misc_feature 1..1859: note = mRNA product Design e-2 comprising derived and/or modified sequence from HRSV(A2)__F-del_DSCav1_mut5 (opt5)
  source 1..1859: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcggatgcggcgtttctgtgctgacatttaaggtccttgacctgaagaactacattgataaacaactcctgcctatcctgaataagcagtcctgtagcatttctaacatcgagaccgtgattgagttccagcagaaaaataaccggctcctggaaatcacgcgcgagttttccgtgaatgccggcgtcacaaccccggttagcacatatatgcttaccaactccgaactgctctctctgatcaatgacatgcccattaccaacgatcaaaagaaacttatgagcaacaatgtgcagatcgtgagacagcagtcctacagcattatgtgcatcattaaggaggaagtcctggcttatgtggttcaactccctctgtacggggtgatcgacacaccctgttggaaactgcatacgtctcctctctgcaccacaaacaccaaggagggatccaatatctgtctgacacggaccgatcgcggctggtactgcgacaacgccgggagcgtctctttctttccccaggcggaaacgtgtaaggtgcagagcaatagagttttctgcgatacaatgaactccagaaccctgccttctgaggtgaatctctgcaacgtcgacatttttaatccgaaatatgattgtaagatcatgaccagcaaaacagacgtgtccagctctgtcattacctccctgggagccatcgtgagctgctacggcaagacaaaatgtacggcttctaacaagtgccgggggattatcaagaccttctccaatggatgtgattatgttagcaacaaaggcgtggacacagtctccgtgggcaataccctttactatgttaacaagcaagaggggaaatctctgtacgtgaagggagaacccatcattaatttttatgaccctctcgtcttccccagcgatgagtttgacgcctccatctctcaggtgaacgagaaaattaaccagagcctggctttcatccgcaagtccgatgaactgctccacaatgtgaacgccggcaagagcacaaccaatattatgatcacgaccattatcatcgttattatcgtcattctgctttctctgatcgccgtggggctcctgctgtactgcaaagctagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5878 - RNA, 1859 nt, synthetic construct
  misc_feature 1..1859: note = mRNA product Design e-2 comprising derived and/or modified sequence from HRSV(A2)__F-del_DSCav1_mut5 (opt6)
  source 1..1859: mol_type = other RNA
gggagacccgtgacccggaagttgtacggctacgcgactttccctcccacaaaccctcgcgcccttcctttcctacttgggcccggcagaaagcttaccatggaacttttaatactgaaagcaaatgccatcacaaccatactaactgccgtcacattctgctttgcatcaggacaaaacataacagaagaattttaccaatccacatgctcagcagtatcaaaaggatatctatcggcacttagaactggatggtacacaagtgttataactatagaactctcaaacataaaagaaaacaaatgcaatggaacagacgcaaaagtaaaactaataaaacaagaactcgataaatataaaaatgcagtaaccgaactacaactattaatgcaaagcacacccgcaacaggcagcggatcagcaatagcaagcggagtcgcagtatgtaaagtactacatctagaaggagaagtcaacaaaatcaaatctgcacttctatccacaaacaaagctgtagtatccctatccggatgcggagtctcagtattaacttttaaagtactagaccttaaaaactacatagataaacaactattaccaatactaaataaacaatcatgcagcatatccaatatagagacagtaattgaatttcaacaaaaaaacaacagattactagaaattactcgtgaattttccgtaaatgccggagtcacaacaccagtatcaacctatatgctaacaaacagcgaactacttagcttaataaatgacatgccaataacaaatgaccaaaaaaaacttatgtcaaataacgtacaaatcgtcagacaacaatcctactctataatgtgtataattaaagaagaagtcctagcatacgtagttcaattaccactctatggagtaatagatacaccatgctggaaactacacacgtcaccactatgtacaacaaacacaaaagaaggatccaatatatgcctaacaagaaccgacagaggctggtattgtgacaacgcaggatccgtttcattcttcccacaagcagaaacctgtaaagtacaatctaatagagtattttgcgacacaatgaacagtagaacactaccaagcgaggttaatctatgtaacgtagacatattcaatccaaaatatgattgcaaaataatgacatcaaaaacagatgtatcgtcgagtgtaataacaagtctgggagctatagtaagctgctacggcaagacgaaatgtaccgcttcaaataaatgcagaggaatcattaaaacattctcgaacggatgcgactacgtaagtaataaaggtgtcgacaccgtatcagtagggaatacattatactacgtcaacaaacaagaaggaaaatctctatatgtaaaaggagaaccaataataaatttctatgaccctctagtattcccatcagatgaatttgacgcttccatatcacaagtaaacgaaaaaatcaatcaatctttagcattcatacgaaaaagtgatgaactcctacacaacgtcaacgcaggaaaaagcacaacaaatataatgatcacaacaatcatcatagtaataatagtaatactactatcattaatagcagtaggattattgctttactgcaaagcacgatagggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5879 - RNA, 1859 nt, synthetic construct
  misc_feature 1..1859: note = mRNA product Design e-2 comprising derived and/or modified sequence from HRSV(A2)__F-del_DSCav1_mut5 (opt11)
  source 1..1859: mol_type = other RNA
gggagacccgtgacccggaagttgtacggctacgcgactttccctcccacaaaccctcgcgcccttcctttcctacttgggcccggcagaaagcttaccatggaactcctcatcctcaaagccaacgccataaccacaatactcaccgccgtaaccttctgctttgcgtcgggacaaaacatcaccgaagagttctaccaatccacttgctccgcagtaagcaaaggatacctctccgccctgcgaaccggttggtacacatcagtcatcacaatcgaactctcaaacataaaagaaaacaaatgcaacggcaccgacgcaaaggtcaaattaatcaagcaagaactagacaaatacaaaaacgccgtcacagaactccagctgctaatgcagagcacacccgcaactggcagcggatccgccatcgcatcaggagtcgccgtgtgcaaagtcctacacctcgaaggagaagtgaacaaaatcaaatcagccctactctccaccaacaaggccgtcgtctccctctccggctgcggtgtctccgtcctaaccttcaaagtgctagacctcaagaactacatcgacaaacaactcctaccaatactcaacaagcaatcttgctccatctccaacatcgaaaccgtaatcgagttccaacagaagaacaaccgcctcctcgaaatcacccgcgagttctctgtcaacgcaggggtcaccactcccgtctccacatacatgctcacaaactccgaactcctcagcctcatcaacgacatgcccataaccaacgaccagaaaaagctaatgagcaataacgtccaaatcgttagacaacaaagttattccatcatgtgcatcatcaaagaagaagtcctcgcctacgtcgtacaactccccctctatggcgtcatcgacaccccctgctggaaactgcacacatcacccctctgcaccacaaacaccaaagaaggctcaaacatctgcctaactcgcaccgaccgcggctggtactgcgacaacgccggcagcgtatcattctttccccaagccgaaacatgcaaagttcaatccaaccgcgtcttctgcgacacaatgaactccagaacgctccccagcgaagtcaacctctgtaacgtagacatcttcaaccctaagtacgactgcaaaatcatgacctccaaaactgatgtatcctcctccgtcatcacatccctgggcgccatcgtcagctgctacggcaaaacaaaatgcactgcctcaaacaaatgccgaggtatcataaagaccttctcaaacggatgcgattacgtcagcaacaaaggcgtcgacaccgtcagtgtcggcaacaccctctactacgtcaacaaacaagaaggaaaatccctctacgtcaaaggcgaacccatcatcaacttctacgaccccctcgtcttccccagcgacgagttcgacgcctccatctcacaagtcaacgaaaagataaaccaatctctagccttcatccgcaaatccgatgaactcctgcataacgtcaacgccggcaaatccaccacaaacatcatgatcactaccataatcatcgtcataatcgtaatcctcctatctcttatcgcagtcggcctactactctactgcaaagcccgctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5880 - RNA, 1829 nt, synthetic construct
  misc_feature 1..1829: note = mRNA product Design e-3 comprising derived and/or modified sequence from HRSV(A2)__F-del_DSCav1_mut5 (opt1)
  source 1..1829: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5881 - RNA, 1829 nt, synthetic construct
  misc_feature 1..1829: note = mRNA product Design e-3 comprising derived and/or modified sequence from HRSV(A2)__F-del_DSCav1_mut5 (opt1)
  source 1..1829: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcgggtgcggcgtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggggtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggcgtgatcgacacgccgtgctggaagctgcacaccagccccctctgcaccaccaacacgaaggaggggtccaacatctgcctgacccgcaccgaccggggctggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggggccatcgtgtcctgctacggcaagaccaagtgcaccgccagcaacaagtgccgggggatcatcaagaccttctccaacggctgcgactacgtgagcaacaagggcgtcgacacggtgagcgtggggaacaccctctactacgtcaacaagcaggagggcaagtccctgtacgtgaagggggagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccggcaagtccaccaccaacatcatgatcaccacgatcatcatcgtgatcatcgtcatcctcctgagcctgatcgccgtggggctcctgctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5882 - RNA, 1829 nt, synthetic construct
  misc_feature 1..1829: note = mRNA product Design e-3 comprising derived and/or modified sequence from HRSV(A2)__F-del_DSCav1_mut5 (opt2)
  source 1..1829: mol_type = other RNA
gggagactttcccattctgtagcagaatttggtgttgcctgtggtcttggtcccgcggagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5883 - RNA, 1829 nt, synthetic construct
  misc_feature 1..1829: note = mRNA product Design e-3 comprising derived and/or modified sequence from HRSV(A2)__F-del_DSCav1_mut5 (opt3)
  source 1..1829: mol_type = other RNA
gggagactttcccattctgtagcagaatttggtgttgcctgtggtcttggtcccgcggagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcggttgcggggtgtccgtattaacttttaaggttctggaccttaagaactacattgataaacaattgctgcctatcctaaataagcagtcatgtagtattagcaacatcgagaccgtgatagagttccagcagaaaaataacaggctcctggaaattacacgggagttttctgtcaatgcgggagtgactaccccagtgtccacatatatgcttaccaactcagaactgttgagcctcatcaatgacatgccgattacgaacgatcaaaagaaactgatgagtaacaatgtccagatcgttcgccagcagtcttactccatcatgtgcattataaaggaggaagtgttagcatatgtagtgcaactgcccctctacggcgtcatcgacactccttgttggaaacttcatacaagcccactgtgcaccactaacacaaaggagggctcgaatatttgtttgacccgaacggatcgtgggtggtactgcgacaacgccggatctgtgtccttctttccccaggctgaaacctgtaaggttcagtcaaatagagtgttctgcgatacaatgaacagtagaactctgcctagcgaggtcaatctctgcaacgtggacatctttaatccaaaatatgattgtaagataatgacctccaaaacagacgtatctagctcagttattaccagtctgggtgccatcgtgtcctgctacggcaagactaaatgtacagcaagcaacaagtgcagggggatcattaagaccttctctaatggatgtgattatgtctcaaacaaaggcgtggacactgtcagtgtgggtaatacgctttactatgttaacaagcaagaggggaaaagcctgtacgtgaagggagaacccatcattaatttttatgaccctttggtattcccatccgatgagtttgacgcttctatatcgcaggtcaacgagaaaatcaaccagagcctcgccttcattcggaagtccgatgaactgttacacaatgtgaacgcgggcaagtcaacaaccaatatcatgatcactaccattataatcgttattatcgtgattctgctaagtctcatcgccgtcggcctgcttttgtactgcaaagcacgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5884 - RNA, 1829 nt, synthetic construct
  misc_feature 1..1829: note = mRNA product Design e-3 comprising derived and/or modified sequence from HRSV(A2)__F-del_DSCav1_mut5 (opt4)
  source 1..1829: mol_type = other RNA
gggagactttcccattctgtagcagaatttggtgttgcctgtggtcttggtcccgcggagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5885 - RNA, 1829 nt, synthetic construct
  misc_feature 1..1829: note = mRNA product Design e-3 comprising derived and/or modified sequence from HRSV(A2)__F-del_DSCav1_mut5 (opt5)
  source 1..1829: mol_type = other RNA
gggagactttcccattctgtagcagaatttggtgttgcctgtggtcttggtcccgcggagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcggatgcggcgtttctgtgctgacatttaaggtccttgacctgaagaactacattgataaacaactcctgcctatcctgaataagcagtcctgtagcatttctaacatcgagaccgtgattgagttccagcagaaaaataaccggctcctggaaatcacgcgcgagttttccgtgaatgccggcgtcacaaccccggttagcacatatatgcttaccaactccgaactgctctctctgatcaatgacatgcccattaccaacgatcaaaagaaacttatgagcaacaatgtgcagatcgtgagacagcagtcctacagcattatgtgcatcattaaggaggaagtcctggcttatgtggttcaactccctctgtacggggtgatcgacacaccctgttggaaactgcatacgtctcctctctgcaccacaaacaccaaggagggatccaatatctgtctgacacggaccgatcgcggctggtactgcgacaacgccgggagcgtctctttctttccccaggcggaaacgtgtaaggtgcagagcaatagagttttctgcgatacaatgaactccagaaccctgccttctgaggtgaatctctgcaacgtcgacatttttaatccgaaatatgattgtaagatcatgaccagcaaaacagacgtgtccagctctgtcattacctccctgggagccatcgtgagctgctacggcaagacaaaatgtacggcttctaacaagtgccgggggattatcaagaccttctccaatggatgtgattatgttagcaacaaaggcgtggacacagtctccgtgggcaataccctttactatgttaacaagcaagaggggaaatctctgtacgtgaagggagaacccatcattaatttttatgaccctctcgtcttccccagcgatgagtttgacgcctccatctctcaggtgaacgagaaaattaaccagagcctggctttcatccgcaagtccgatgaactgctccacaatgtgaacgccggcaagagcacaaccaatattatgatcacgaccattatcatcgttattatcgtcattctgctttctctgatcgccgtggggctcctgctgtactgcaaagctagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5886 - RNA, 1829 nt, synthetic construct
  misc_feature 1..1829: note = mRNA product Design e-3 comprising derived and/or modified sequence from HRSV(A2)__F-del_DSCav1_mut5 (opt6)
  source 1..1829: mol_type = other RNA
gggagactttcccattctgtagcagaatttggtgttgcctgtggtcttggtcccgcggagaagcttaccatggaacttttaatactgaaagcaaatgccatcacaaccatactaactgccgtcacattctgctttgcatcaggacaaaacataacagaagaattttaccaatccacatgctcagcagtatcaaaaggatatctatcggcacttagaactggatggtacacaagtgttataactatagaactctcaaacataaaagaaaacaaatgcaatggaacagacgcaaaagtaaaactaataaaacaagaactcgataaatataaaaatgcagtaaccgaactacaactattaatgcaaagcacacccgcaacaggcagcggatcagcaatagcaagcggagtcgcagtatgtaaagtactacatctagaaggagaagtcaacaaaatcaaatctgcacttctatccacaaacaaagctgtagtatccctatccggatgcggagtctcagtattaacttttaaagtactagaccttaaaaactacatagataaacaactattaccaatactaaataaacaatcatgcagcatatccaatatagagacagtaattgaatttcaacaaaaaaacaacagattactagaaattactcgtgaattttccgtaaatgccggagtcacaacaccagtatcaacctatatgctaacaaacagcgaactacttagcttaataaatgacatgccaataacaaatgaccaaaaaaaacttatgtcaaataacgtacaaatcgtcagacaacaatcctactctataatgtgtataattaaagaagaagtcctagcatacgtagttcaattaccactctatggagtaatagatacaccatgctggaaactacacacgtcaccactatgtacaacaaacacaaaagaaggatccaatatatgcctaacaagaaccgacagaggctggtattgtgacaacgcaggatccgtttcattcttcccacaagcagaaacctgtaaagtacaatctaatagagtattttgcgacacaatgaacagtagaacactaccaagcgaggttaatctatgtaacgtagacatattcaatccaaaatatgattgcaaaataatgacatcaaaaacagatgtatcgtcgagtgtaataacaagtctgggagctatagtaagctgctacggcaagacgaaatgtaccgcttcaaataaatgcagaggaatcattaaaacattctcgaacggatgcgactacgtaagtaataaaggtgtcgacaccgtatcagtagggaatacattatactacgtcaacaaacaagaaggaaaatctctatatgtaaaaggagaaccaataataaatttctatgaccctctagtattcccatcagatgaatttgacgcttccatatcacaagtaaacgaaaaaatcaatcaatctttagcattcatacgaaaaagtgatgaactcctacacaacgtcaacgcaggaaaaagcacaacaaatataatgatcacaacaatcatcatagtaataatagtaatactactatcattaatagcagtaggattattgctttactgcaaagcacgatagggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5887 - RNA, 1829 nt, synthetic construct
  misc_feature 1..1829: note = mRNA product Design e-3 comprising derived and/or modified sequence from HRSV(A2)__F-del_DSCav1_mut5 (opt11)
  source 1..1829: mol_type = other RNA
gggagactttcccattctgtagcagaatttggtgttgcctgtggtcttggtcccgcggagaagcttaccatggaactcctcatcctcaaagccaacgccataaccacaatactcaccgccgtaaccttctgctttgcgtcgggacaaaacatcaccgaagagttctaccaatccacttgctccgcagtaagcaaaggatacctctccgccctgcgaaccggttggtacacatcagtcatcacaatcgaactctcaaacataaaagaaaacaaatgcaacggcaccgacgcaaaggtcaaattaatcaagcaagaactagacaaatacaaaaacgccgtcacagaactccagctgctaatgcagagcacacccgcaactggcagcggatccgccatcgcatcaggagtcgccgtgtgcaaagtcctacacctcgaaggagaagtgaacaaaatcaaatcagccctactctccaccaacaaggccgtcgtctccctctccggctgcggtgtctccgtcctaaccttcaaagtgctagacctcaagaactacatcgacaaacaactcctaccaatactcaacaagcaatcttgctccatctccaacatcgaaaccgtaatcgagttccaacagaagaacaaccgcctcctcgaaatcacccgcgagttctctgtcaacgcaggggtcaccactcccgtctccacatacatgctcacaaactccgaactcctcagcctcatcaacgacatgcccataaccaacgaccagaaaaagctaatgagcaataacgtccaaatcgttagacaacaaagttattccatcatgtgcatcatcaaagaagaagtcctcgcctacgtcgtacaactccccctctatggcgtcatcgacaccccctgctggaaactgcacacatcacccctctgcaccacaaacaccaaagaaggctcaaacatctgcctaactcgcaccgaccgcggctggtactgcgacaacgccggcagcgtatcattctttccccaagccgaaacatgcaaagttcaatccaaccgcgtcttctgcgacacaatgaactccagaacgctccccagcgaagtcaacctctgtaacgtagacatcttcaaccctaagtacgactgcaaaatcatgacctccaaaactgatgtatcctcctccgtcatcacatccctgggcgccatcgtcagctgctacggcaaaacaaaatgcactgcctcaaacaaatgccgaggtatcataaagaccttctcaaacggatgcgattacgtcagcaacaaaggcgtcgacaccgtcagtgtcggcaacaccctctactacgtcaacaaacaagaaggaaaatccctctacgtcaaaggcgaacccatcatcaacttctacgaccccctcgtcttccccagcgacgagttcgacgcctccatctcacaagtcaacgaaaagataaaccaatctctagccttcatccgcaaatccgatgaactcctgcataacgtcaacgccggcaaatccaccacaaacatcatgatcactaccataatcatcgtcataatcgtaatcctcctatctcttatcgcagtcggcctactactctactgcaaagcccgctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5888 - RNA, 1883 nt, synthetic construct
  misc_feature 1..1883: note = mRNA product Design e-4 comprising derived and/or modified sequence from HRSV(A2)__F-del_DSCav1_mut5 (opt1)
  source 1..1883: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5889 - RNA, 1883 nt, synthetic construct
  misc_feature 1..1883: note = mRNA product Design e-4 comprising derived and/or modified sequence from HRSV(A2)__F-del_DSCav1_mut5 (opt1)
  source 1..1883: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcgggtgcggcgtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggggtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggcgtgatcgacacgccgtgctggaagctgcacaccagccccctctgcaccaccaacacgaaggaggggtccaacatctgcctgacccgcaccgaccggggctggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggggccatcgtgtcctgctacggcaagaccaagtgcaccgccagcaacaagtgccgggggatcatcaagaccttctccaacggctgcgactacgtgagcaacaagggcgtcgacacggtgagcgtggggaacaccctctactacgtcaacaagcaggagggcaagtccctgtacgtgaagggggagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccggcaagtccaccaccaacatcatgatcaccacgatcatcatcgtgatcatcgtcatcctcctgagcctgatcgccgtggggctcctgctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5890 - RNA, 1883 nt, synthetic construct
  misc_feature 1..1883: note = mRNA product Design e-4 comprising derived and/or modified sequence from HRSV(A2)__F-del_DSCav1_mut5 (opt2)
  source 1..1883: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5891 - RNA, 1883 nt, synthetic construct
  misc_feature 1..1883: note = mRNA product Design e-4 comprising derived and/or modified sequence from HRSV(A2)__F-del_DSCav1_mut5 (opt3)
  source 1..1883: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcggttgcggggtgtccgtattaacttttaaggttctggaccttaagaactacattgataaacaattgctgcctatcctaaataagcagtcatgtagtattagcaacatcgagaccgtgatagagttccagcagaaaaataacaggctcctggaaattacacgggagttttctgtcaatgcgggagtgactaccccagtgtccacatatatgcttaccaactcagaactgttgagcctcatcaatgacatgccgattacgaacgatcaaaagaaactgatgagtaacaatgtccagatcgttcgccagcagtcttactccatcatgtgcattataaaggaggaagtgttagcatatgtagtgcaactgcccctctacggcgtcatcgacactccttgttggaaacttcatacaagcccactgtgcaccactaacacaaaggagggctcgaatatttgtttgacccgaacggatcgtgggtggtactgcgacaacgccggatctgtgtccttctttccccaggctgaaacctgtaaggttcagtcaaatagagtgttctgcgatacaatgaacagtagaactctgcctagcgaggtcaatctctgcaacgtggacatctttaatccaaaatatgattgtaagataatgacctccaaaacagacgtatctagctcagttattaccagtctgggtgccatcgtgtcctgctacggcaagactaaatgtacagcaagcaacaagtgcagggggatcattaagaccttctctaatggatgtgattatgtctcaaacaaaggcgtggacactgtcagtgtgggtaatacgctttactatgttaacaagcaagaggggaaaagcctgtacgtgaagggagaacccatcattaatttttatgaccctttggtattcccatccgatgagtttgacgcttctatatcgcaggtcaacgagaaaatcaaccagagcctcgccttcattcggaagtccgatgaactgttacacaatgtgaacgcgggcaagtcaacaaccaatatcatgatcactaccattataatcgttattatcgtgattctgctaagtctcatcgccgtcggcctgcttttgtactgcaaagcacgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5892 - RNA, 1883 nt, synthetic construct
  misc_feature 1..1883: note = mRNA product Design e-4 comprising derived and/or modified sequence from HRSV(A2)__F-del_DSCav1_mut5 (opt4)
  source 1..1883: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5893 - RNA, 1883 nt, synthetic construct
  misc_feature 1..1883: note = mRNA product Design e-4 comprising derived and/or modified sequence from HRSV(A2)__F-del_DSCav1_mut5 (opt5)
  source 1..1883: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcggatgcggcgtttctgtgctgacatttaaggtccttgacctgaagaactacattgataaacaactcctgcctatcctgaataagcagtcctgtagcatttctaacatcgagaccgtgattgagttccagcagaaaaataaccggctcctggaaatcacgcgcgagttttccgtgaatgccggcgtcacaaccccggttagcacatatatgcttaccaactccgaactgctctctctgatcaatgacatgcccattaccaacgatcaaaagaaacttatgagcaacaatgtgcagatcgtgagacagcagtcctacagcattatgtgcatcattaaggaggaagtcctggcttatgtggttcaactccctctgtacggggtgatcgacacaccctgttggaaactgcatacgtctcctctctgcaccacaaacaccaaggagggatccaatatctgtctgacacggaccgatcgcggctggtactgcgacaacgccgggagcgtctctttctttccccaggcggaaacgtgtaaggtgcagagcaatagagttttctgcgatacaatgaactccagaaccctgccttctgaggtgaatctctgcaacgtcgacatttttaatccgaaatatgattgtaagatcatgaccagcaaaacagacgtgtccagctctgtcattacctccctgggagccatcgtgagctgctacggcaagacaaaatgtacggcttctaacaagtgccgggggattatcaagaccttctccaatggatgtgattatgttagcaacaaaggcgtggacacagtctccgtgggcaataccctttactatgttaacaagcaagaggggaaatctctgtacgtgaagggagaacccatcattaatttttatgaccctctcgtcttccccagcgatgagtttgacgcctccatctctcaggtgaacgagaaaattaaccagagcctggctttcatccgcaagtccgatgaactgctccacaatgtgaacgccggcaagagcacaaccaatattatgatcacgaccattatcatcgttattatcgtcattctgctttctctgatcgccgtggggctcctgctgtactgcaaagctagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5894 - RNA, 1883 nt, synthetic construct
  misc_feature 1..1883: note = mRNA product Design e-4 comprising derived and/or modified sequence from HRSV(A2)__F-del_DSCav1_mut5 (opt6)
  source 1..1883: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaacttttaatactgaaagcaaatgccatcacaaccatactaactgccgtcacattctgctttgcatcaggacaaaacataacagaagaattttaccaatccacatgctcagcagtatcaaaaggatatctatcggcacttagaactggatggtacacaagtgttataactatagaactctcaaacataaaagaaaacaaatgcaatggaacagacgcaaaagtaaaactaataaaacaagaactcgataaatataaaaatgcagtaaccgaactacaactattaatgcaaagcacacccgcaacaggcagcggatcagcaatagcaagcggagtcgcagtatgtaaagtactacatctagaaggagaagtcaacaaaatcaaatctgcacttctatccacaaacaaagctgtagtatccctatccggatgcggagtctcagtattaacttttaaagtactagaccttaaaaactacatagataaacaactattaccaatactaaataaacaatcatgcagcatatccaatatagagacagtaattgaatttcaacaaaaaaacaacagattactagaaattactcgtgaattttccgtaaatgccggagtcacaacaccagtatcaacctatatgctaacaaacagcgaactacttagcttaataaatgacatgccaataacaaatgaccaaaaaaaacttatgtcaaataacgtacaaatcgtcagacaacaatcctactctataatgtgtataattaaagaagaagtcctagcatacgtagttcaattaccactctatggagtaatagatacaccatgctggaaactacacacgtcaccactatgtacaacaaacacaaaagaaggatccaatatatgcctaacaagaaccgacagaggctggtattgtgacaacgcaggatccgtttcattcttcccacaagcagaaacctgtaaagtacaatctaatagagtattttgcgacacaatgaacagtagaacactaccaagcgaggttaatctatgtaacgtagacatattcaatccaaaatatgattgcaaaataatgacatcaaaaacagatgtatcgtcgagtgtaataacaagtctgggagctatagtaagctgctacggcaagacgaaatgtaccgcttcaaataaatgcagaggaatcattaaaacattctcgaacggatgcgactacgtaagtaataaaggtgtcgacaccgtatcagtagggaatacattatactacgtcaacaaacaagaaggaaaatctctatatgtaaaaggagaaccaataataaatttctatgaccctctagtattcccatcagatgaatttgacgcttccatatcacaagtaaacgaaaaaatcaatcaatctttagcattcatacgaaaaagtgatgaactcctacacaacgtcaacgcaggaaaaagcacaacaaatataatgatcacaacaatcatcatagtaataatagtaatactactatcattaatagcagtaggattattgctttactgcaaagcacgatagggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5895 - RNA, 1883 nt, synthetic construct
  misc_feature 1..1883: note = mRNA product Design e-4 comprising derived and/or modified sequence from HRSV(A2)__F-del_DSCav1_mut5 (opt11)
  source 1..1883: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactcctcatcctcaaagccaacgccataaccacaatactcaccgccgtaaccttctgctttgcgtcgggacaaaacatcaccgaagagttctaccaatccacttgctccgcagtaagcaaaggatacctctccgccctgcgaaccggttggtacacatcagtcatcacaatcgaactctcaaacataaaagaaaacaaatgcaacggcaccgacgcaaaggtcaaattaatcaagcaagaactagacaaatacaaaaacgccgtcacagaactccagctgctaatgcagagcacacccgcaactggcagcggatccgccatcgcatcaggagtcgccgtgtgcaaagtcctacacctcgaaggagaagtgaacaaaatcaaatcagccctactctccaccaacaaggccgtcgtctccctctccggctgcggtgtctccgtcctaaccttcaaagtgctagacctcaagaactacatcgacaaacaactcctaccaatactcaacaagcaatcttgctccatctccaacatcgaaaccgtaatcgagttccaacagaagaacaaccgcctcctcgaaatcacccgcgagttctctgtcaacgcaggggtcaccactcccgtctccacatacatgctcacaaactccgaactcctcagcctcatcaacgacatgcccataaccaacgaccagaaaaagctaatgagcaataacgtccaaatcgttagacaacaaagttattccatcatgtgcatcatcaaagaagaagtcctcgcctacgtcgtacaactccccctctatggcgtcatcgacaccccctgctggaaactgcacacatcacccctctgcaccacaaacaccaaagaaggctcaaacatctgcctaactcgcaccgaccgcggctggtactgcgacaacgccggcagcgtatcattctttccccaagccgaaacatgcaaagttcaatccaaccgcgtcttctgcgacacaatgaactccagaacgctccccagcgaagtcaacctctgtaacgtagacatcttcaaccctaagtacgactgcaaaatcatgacctccaaaactgatgtatcctcctccgtcatcacatccctgggcgccatcgtcagctgctacggcaaaacaaaatgcactgcctcaaacaaatgccgaggtatcataaagaccttctcaaacggatgcgattacgtcagcaacaaaggcgtcgacaccgtcagtgtcggcaacaccctctactacgtcaacaaacaagaaggaaaatccctctacgtcaaaggcgaacccatcatcaacttctacgaccccctcgtcttccccagcgacgagttcgacgcctccatctcacaagtcaacgaaaagataaaccaatctctagccttcatccgcaaatccgatgaactcctgcataacgtcaacgccggcaaatccaccacaaacatcatgatcactaccataatcatcgtcataatcgtaatcctcctatctcttatcgcagtcggcctactactctactgcaaagcccgctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5896 - RNA, 1850 nt, synthetic construct
  misc_feature 1..1850: note = mRNA product Design e-5 comprising derived and/or modified sequence from HRSV(A2)__F-del_DSCav1_mut5 (opt1)
  source 1..1850: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5897 - RNA, 1850 nt, synthetic construct
  misc_feature 1..1850: note = mRNA product Design e-5 comprising derived and/or modified sequence from HRSV(A2)__F-del_DSCav1_mut5 (opt1)
  source 1..1850: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcgggtgcggcgtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggggtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggcgtgatcgacacgccgtgctggaagctgcacaccagccccctctgcaccaccaacacgaaggaggggtccaacatctgcctgacccgcaccgaccggggctggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggggccatcgtgtcctgctacggcaagaccaagtgcaccgccagcaacaagtgccgggggatcatcaagaccttctccaacggctgcgactacgtgagcaacaagggcgtcgacacggtgagcgtggggaacaccctctactacgtcaacaagcaggagggcaagtccctgtacgtgaagggggagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccggcaagtccaccaccaacatcatgatcaccacgatcatcatcgtgatcatcgtcatcctcctgagcctgatcgccgtggggctcctgctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5898 - RNA, 1850 nt, synthetic construct
  misc_feature 1..1850: note = mRNA product Design e-5 comprising derived and/or modified sequence from HRSV(A2)__F-del_DSCav1_mut5 (opt2)
  source 1..1850: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5899 - RNA, 1850 nt, synthetic construct
  misc_feature 1..1850: note = mRNA product Design e-5 comprising derived and/or modified sequence from HRSV(A2)__F-del_DSCav1_mut5 (opt3)
  source 1..1850: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcggttgcggggtgtccgtattaacttttaaggttctggaccttaagaactacattgataaacaattgctgcctatcctaaataagcagtcatgtagtattagcaacatcgagaccgtgatagagttccagcagaaaaataacaggctcctggaaattacacgggagttttctgtcaatgcgggagtgactaccccagtgtccacatatatgcttaccaactcagaactgttgagcctcatcaatgacatgccgattacgaacgatcaaaagaaactgatgagtaacaatgtccagatcgttcgccagcagtcttactccatcatgtgcattataaaggaggaagtgttagcatatgtagtgcaactgcccctctacggcgtcatcgacactccttgttggaaacttcatacaagcccactgtgcaccactaacacaaaggagggctcgaatatttgtttgacccgaacggatcgtgggtggtactgcgacaacgccggatctgtgtccttctttccccaggctgaaacctgtaaggttcagtcaaatagagtgttctgcgatacaatgaacagtagaactctgcctagcgaggtcaatctctgcaacgtggacatctttaatccaaaatatgattgtaagataatgacctccaaaacagacgtatctagctcagttattaccagtctgggtgccatcgtgtcctgctacggcaagactaaatgtacagcaagcaacaagtgcagggggatcattaagaccttctctaatggatgtgattatgtctcaaacaaaggcgtggacactgtcagtgtgggtaatacgctttactatgttaacaagcaagaggggaaaagcctgtacgtgaagggagaacccatcattaatttttatgaccctttggtattcccatccgatgagtttgacgcttctatatcgcaggtcaacgagaaaatcaaccagagcctcgccttcattcggaagtccgatgaactgttacacaatgtgaacgcgggcaagtcaacaaccaatatcatgatcactaccattataatcgttattatcgtgattctgctaagtctcatcgccgtcggcctgcttttgtactgcaaagcacgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5900 - RNA, 1850 nt, synthetic construct
  misc_feature 1..1850: note = mRNA product Design e-5 comprising derived and/or modified sequence from HRSV(A2)__F-del_DSCav1_mut5 (opt4)
  source 1..1850: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5901 - RNA, 1850 nt, synthetic construct
  misc_feature 1..1850: note = mRNA product Design e-5 comprising derived and/or modified sequence from HRSV(A2)__F-del_DSCav1_mut5 (opt5)
  source 1..1850: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcggatgcggcgtttctgtgctgacatttaaggtccttgacctgaagaactacattgataaacaactcctgcctatcctgaataagcagtcctgtagcatttctaacatcgagaccgtgattgagttccagcagaaaaataaccggctcctggaaatcacgcgcgagttttccgtgaatgccggcgtcacaaccccggttagcacatatatgcttaccaactccgaactgctctctctgatcaatgacatgcccattaccaacgatcaaaagaaacttatgagcaacaatgtgcagatcgtgagacagcagtcctacagcattatgtgcatcattaaggaggaagtcctggcttatgtggttcaactccctctgtacggggtgatcgacacaccctgttggaaactgcatacgtctcctctctgcaccacaaacaccaaggagggatccaatatctgtctgacacggaccgatcgcggctggtactgcgacaacgccgggagcgtctctttctttccccaggcggaaacgtgtaaggtgcagagcaatagagttttctgcgatacaatgaactccagaaccctgccttctgaggtgaatctctgcaacgtcgacatttttaatccgaaatatgattgtaagatcatgaccagcaaaacagacgtgtccagctctgtcattacctccctgggagccatcgtgagctgctacggcaagacaaaatgtacggcttctaacaagtgccgggggattatcaagaccttctccaatggatgtgattatgttagcaacaaaggcgtggacacagtctccgtgggcaataccctttactatgttaacaagcaagaggggaaatctctgtacgtgaagggagaacccatcattaatttttatgaccctctcgtcttccccagcgatgagtttgacgcctccatctctcaggtgaacgagaaaattaaccagagcctggctttcatccgcaagtccgatgaactgctccacaatgtgaacgccggcaagagcacaaccaatattatgatcacgaccattatcatcgttattatcgtcattctgctttctctgatcgccgtggggctcctgctgtactgcaaagctagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5902 - RNA, 1850 nt, synthetic construct
  misc_feature 1..1850: note = mRNA product Design e-5 comprising derived and/or modified sequence from HRSV(A2)__F-del_DSCav1_mut5 (opt6)
  source 1..1850: mol_type = other RNA
gggagagcggctcggccattttgtcccagtcagtccggaggctgcggctgcagaagtaccgcctgcggagtaactgcaaagaagcttaccatggaacttttaatactgaaagcaaatgccatcacaaccatactaactgccgtcacattctgctttgcatcaggacaaaacataacagaagaattttaccaatccacatgctcagcagtatcaaaaggatatctatcggcacttagaactggatggtacacaagtgttataactatagaactctcaaacataaaagaaaacaaatgcaatggaacagacgcaaaagtaaaactaataaaacaagaactcgataaatataaaaatgcagtaaccgaactacaactattaatgcaaagcacacccgcaacaggcagcggatcagcaatagcaagcggagtcgcagtatgtaaagtactacatctagaaggagaagtcaacaaaatcaaatctgcacttctatccacaaacaaagctgtagtatccctatccggatgcggagtctcagtattaacttttaaagtactagaccttaaaaactacatagataaacaactattaccaatactaaataaacaatcatgcagcatatccaatatagagacagtaattgaatttcaacaaaaaaacaacagattactagaaattactcgtgaattttccgtaaatgccggagtcacaacaccagtatcaacctatatgctaacaaacagcgaactacttagcttaataaatgacatgccaataacaaatgaccaaaaaaaacttatgtcaaataacgtacaaatcgtcagacaacaatcctactctataatgtgtataattaaagaagaagtcctagcatacgtagttcaattaccactctatggagtaatagatacaccatgctggaaactacacacgtcaccactatgtacaacaaacacaaaagaaggatccaatatatgcctaacaagaaccgacagaggctggtattgtgacaacgcaggatccgtttcattcttcccacaagcagaaacctgtaaagtacaatctaatagagtattttgcgacacaatgaacagtagaacactaccaagcgaggttaatctatgtaacgtagacatattcaatccaaaatatgattgcaaaataatgacatcaaaaacagatgtatcgtcgagtgtaataacaagtctgggagctatagtaagctgctacggcaagacgaaatgtaccgcttcaaataaatgcagaggaatcattaaaacattctcgaacggatgcgactacgtaagtaataaaggtgtcgacaccgtatcagtagggaatacattatactacgtcaacaaacaagaaggaaaatctctatatgtaaaaggagaaccaataataaatttctatgaccctctagtattcccatcagatgaatttgacgcttccatatcacaagtaaacgaaaaaatcaatcaatctttagcattcatacgaaaaagtgatgaactcctacacaacgtcaacgcaggaaaaagcacaacaaatataatgatcacaacaatcatcatagtaataatagtaatactactatcattaatagcagtaggattattgctttactgcaaagcacgatagggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5903 - RNA, 1850 nt, synthetic construct
  misc_feature 1..1850: note = mRNA product Design e-5 comprising derived and/or modified sequence from HRSV(A2)__F-del_DSCav1_mut5 (opt11)
  source 1..1850: mol_type = other RNA
gggagagcggctcggccattttgtcccagtcagtccggaggctgcggctgcagaagtaccgcctgcggagtaactgcaaagaagcttaccatggaactcctcatcctcaaagccaacgccataaccacaatactcaccgccgtaaccttctgctttgcgtcgggacaaaacatcaccgaagagttctaccaatccacttgctccgcagtaagcaaaggatacctctccgccctgcgaaccggttggtacacatcagtcatcacaatcgaactctcaaacataaaagaaaacaaatgcaacggcaccgacgcaaaggtcaaattaatcaagcaagaactagacaaatacaaaaacgccgtcacagaactccagctgctaatgcagagcacacccgcaactggcagcggatccgccatcgcatcaggagtcgccgtgtgcaaagtcctacacctcgaaggagaagtgaacaaaatcaaatcagccctactctccaccaacaaggccgtcgtctccctctccggctgcggtgtctccgtcctaaccttcaaagtgctagacctcaagaactacatcgacaaacaactcctaccaatactcaacaagcaatcttgctccatctccaacatcgaaaccgtaatcgagttccaacagaagaacaaccgcctcctcgaaatcacccgcgagttctctgtcaacgcaggggtcaccactcccgtctccacatacatgctcacaaactccgaactcctcagcctcatcaacgacatgcccataaccaacgaccagaaaaagctaatgagcaataacgtccaaatcgttagacaacaaagttattccatcatgtgcatcatcaaagaagaagtcctcgcctacgtcgtacaactccccctctatggcgtcatcgacaccccctgctggaaactgcacacatcacccctctgcaccacaaacaccaaagaaggctcaaacatctgcctaactcgcaccgaccgcggctggtactgcgacaacgccggcagcgtatcattctttccccaagccgaaacatgcaaagttcaatccaaccgcgtcttctgcgacacaatgaactccagaacgctccccagcgaagtcaacctctgtaacgtagacatcttcaaccctaagtacgactgcaaaatcatgacctccaaaactgatgtatcctcctccgtcatcacatccctgggcgccatcgtcagctgctacggcaaaacaaaatgcactgcctcaaacaaatgccgaggtatcataaagaccttctcaaacggatgcgattacgtcagcaacaaaggcgtcgacaccgtcagtgtcggcaacaccctctactacgtcaacaaacaagaaggaaaatccctctacgtcaaaggcgaacccatcatcaacttctacgaccccctcgtcttccccagcgacgagttcgacgcctccatctcacaagtcaacgaaaagataaaccaatctctagccttcatccgcaaatccgatgaactcctgcataacgtcaacgccggcaaatccaccacaaacatcatgatcactaccataatcatcgtcataatcgtaatcctcctatctcttatcgcagtcggcctactactctactgcaaagcccgctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5904 - RNA, 1917 nt, synthetic construct
  misc_feature 1..1917: note = mRNA product Design e-6 comprising derived and/or modified sequence from HRSV(A2)__F-del_DSCav1_mut5 (opt1)
  source 1..1917: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5905 - RNA, 1917 nt, synthetic construct
  misc_feature 1..1917: note = mRNA product Design e-6 comprising derived and/or modified sequence from HRSV(A2)__F-del_DSCav1_mut5 (opt1)
  source 1..1917: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcgggtgcggcgtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggggtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggcgtgatcgacacgccgtgctggaagctgcacaccagccccctctgcaccaccaacacgaaggaggggtccaacatctgcctgacccgcaccgaccggggctggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggggccatcgtgtcctgctacggcaagaccaagtgcaccgccagcaacaagtgccgggggatcatcaagaccttctccaacggctgcgactacgtgagcaacaagggcgtcgacacggtgagcgtggggaacaccctctactacgtcaacaagcaggagggcaagtccctgtacgtgaagggggagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccggcaagtccaccaccaacatcatgatcaccacgatcatcatcgtgatcatcgtcatcctcctgagcctgatcgccgtggggctcctgctgtactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5906 - RNA, 1917 nt, synthetic construct
  misc_feature 1..1917: note = mRNA product Design e-6 comprising derived and/or modified sequence from HRSV(A2)__F-del_DSCav1_mut5 (opt2)
  source 1..1917: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5907 - RNA, 1917 nt, synthetic construct
  misc_feature 1..1917: note = mRNA product Design e-6 comprising derived and/or modified sequence from HRSV(A2)__F-del_DSCav1_mut5 (opt3)
  source 1..1917: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcggttgcggggtgtccgtattaacttttaaggttctggaccttaagaactacattgataaacaattgctgcctatcctaaataagcagtcatgtagtattagcaacatcgagaccgtgatagagttccagcagaaaaataacaggctcctggaaattacacgggagttttctgtcaatgcgggagtgactaccccagtgtccacatatatgcttaccaactcagaactgttgagcctcatcaatgacatgccgattacgaacgatcaaaagaaactgatgagtaacaatgtccagatcgttcgccagcagtcttactccatcatgtgcattataaaggaggaagtgttagcatatgtagtgcaactgcccctctacggcgtcatcgacactccttgttggaaacttcatacaagcccactgtgcaccactaacacaaaggagggctcgaatatttgtttgacccgaacggatcgtgggtggtactgcgacaacgccggatctgtgtccttctttccccaggctgaaacctgtaaggttcagtcaaatagagtgttctgcgatacaatgaacagtagaactctgcctagcgaggtcaatctctgcaacgtggacatctttaatccaaaatatgattgtaagataatgacctccaaaacagacgtatctagctcagttattaccagtctgggtgccatcgtgtcctgctacggcaagactaaatgtacagcaagcaacaagtgcagggggatcattaagaccttctctaatggatgtgattatgtctcaaacaaaggcgtggacactgtcagtgtgggtaatacgctttactatgttaacaagcaagaggggaaaagcctgtacgtgaagggagaacccatcattaatttttatgaccctttggtattcccatccgatgagtttgacgcttctatatcgcaggtcaacgagaaaatcaaccagagcctcgccttcattcggaagtccgatgaactgttacacaatgtgaacgcgggcaagtcaacaaccaatatcatgatcactaccattataatcgttattatcgtgattctgctaagtctcatcgccgtcggcctgcttttgtactgcaaagcacgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5908 - RNA, 1917 nt, synthetic construct
  misc_feature 1..1917: note = mRNA product Design e-6 comprising derived and/or modified sequence from HRSV(A2)__F-del_DSCav1_mut5 (opt4)
  source 1..1917: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5909 - RNA, 1917 nt, synthetic construct
  misc_feature 1..1917: note = mRNA product Design e-6 comprising derived and/or modified sequence from HRSV(A2)__F-del_DSCav1_mut5 (opt5)
  source 1..1917: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcggatgcggcgtttctgtgctgacatttaaggtccttgacctgaagaactacattgataaacaactcctgcctatcctgaataagcagtcctgtagcatttctaacatcgagaccgtgattgagttccagcagaaaaataaccggctcctggaaatcacgcgcgagttttccgtgaatgccggcgtcacaaccccggttagcacatatatgcttaccaactccgaactgctctctctgatcaatgacatgcccattaccaacgatcaaaagaaacttatgagcaacaatgtgcagatcgtgagacagcagtcctacagcattatgtgcatcattaaggaggaagtcctggcttatgtggttcaactccctctgtacggggtgatcgacacaccctgttggaaactgcatacgtctcctctctgcaccacaaacaccaaggagggatccaatatctgtctgacacggaccgatcgcggctggtactgcgacaacgccgggagcgtctctttctttccccaggcggaaacgtgtaaggtgcagagcaatagagttttctgcgatacaatgaactccagaaccctgccttctgaggtgaatctctgcaacgtcgacatttttaatccgaaatatgattgtaagatcatgaccagcaaaacagacgtgtccagctctgtcattacctccctgggagccatcgtgagctgctacggcaagacaaaatgtacggcttctaacaagtgccgggggattatcaagaccttctccaatggatgtgattatgttagcaacaaaggcgtggacacagtctccgtgggcaataccctttactatgttaacaagcaagaggggaaatctctgtacgtgaagggagaacccatcattaatttttatgaccctctcgtcttccccagcgatgagtttgacgcctccatctctcaggtgaacgagaaaattaaccagagcctggctttcatccgcaagtccgatgaactgctccacaatgtgaacgccggcaagagcacaaccaatattatgatcacgaccattatcatcgttattatcgtcattctgctttctctgatcgccgtggggctcctgctgtactgcaaagctagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5910 - RNA, 1917 nt, synthetic construct
  misc_feature 1..1917: note = mRNA product Design e-6 comprising derived and/or modified sequence from HRSV(A2)__F-del_DSCav1_mut5 (opt6)
  source 1..1917: mol_type = other RNA
gggagagcggctcggccattttgtcccagtcagtccggaggctgcggctgcagaagtaccgcctgcggagtaactgcaaagaagcttaccatggaacttttaatactgaaagcaaatgccatcacaaccatactaactgccgtcacattctgctttgcatcaggacaaaacataacagaagaattttaccaatccacatgctcagcagtatcaaaaggatatctatcggcacttagaactggatggtacacaagtgttataactatagaactctcaaacataaaagaaaacaaatgcaatggaacagacgcaaaagtaaaactaataaaacaagaactcgataaatataaaaatgcagtaaccgaactacaactattaatgcaaagcacacccgcaacaggcagcggatcagcaatagcaagcggagtcgcagtatgtaaagtactacatctagaaggagaagtcaacaaaatcaaatctgcacttctatccacaaacaaagctgtagtatccctatccggatgcggagtctcagtattaacttttaaagtactagaccttaaaaactacatagataaacaactattaccaatactaaataaacaatcatgcagcatatccaatatagagacagtaattgaatttcaacaaaaaaacaacagattactagaaattactcgtgaattttccgtaaatgccggagtcacaacaccagtatcaacctatatgctaacaaacagcgaactacttagcttaataaatgacatgccaataacaaatgaccaaaaaaaacttatgtcaaataacgtacaaatcgtcagacaacaatcctactctataatgtgtataattaaagaagaagtcctagcatacgtagttcaattaccactctatggagtaatagatacaccatgctggaaactacacacgtcaccactatgtacaacaaacacaaaagaaggatccaatatatgcctaacaagaaccgacagaggctggtattgtgacaacgcaggatccgtttcattcttcccacaagcagaaacctgtaaagtacaatctaatagagtattttgcgacacaatgaacagtagaacactaccaagcgaggttaatctatgtaacgtagacatattcaatccaaaatatgattgcaaaataatgacatcaaaaacagatgtatcgtcgagtgtaataacaagtctgggagctatagtaagctgctacggcaagacgaaatgtaccgcttcaaataaatgcagaggaatcattaaaacattctcgaacggatgcgactacgtaagtaataaaggtgtcgacaccgtatcagtagggaatacattatactacgtcaacaaacaagaaggaaaatctctatatgtaaaaggagaaccaataataaatttctatgaccctctagtattcccatcagatgaatttgacgcttccatatcacaagtaaacgaaaaaatcaatcaatctttagcattcatacgaaaaagtgatgaactcctacacaacgtcaacgcaggaaaaagcacaacaaatataatgatcacaacaatcatcatagtaataatagtaatactactatcattaatagcagtaggattattgctttactgcaaagcacgatagggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5911 - RNA, 1917 nt, synthetic construct
  misc_feature 1..1917: note = mRNA product Design e-6 comprising derived and/or modified sequence from HRSV(A2)__F-del_DSCav1_mut5 (opt11)
  source 1..1917: mol_type = other RNA
gggagagcggctcggccattttgtcccagtcagtccggaggctgcggctgcagaagtaccgcctgcggagtaactgcaaagaagcttaccatggaactcctcatcctcaaagccaacgccataaccacaatactcaccgccgtaaccttctgctttgcgtcgggacaaaacatcaccgaagagttctaccaatccacttgctccgcagtaagcaaaggatacctctccgccctgcgaaccggttggtacacatcagtcatcacaatcgaactctcaaacataaaagaaaacaaatgcaacggcaccgacgcaaaggtcaaattaatcaagcaagaactagacaaatacaaaaacgccgtcacagaactccagctgctaatgcagagcacacccgcaactggcagcggatccgccatcgcatcaggagtcgccgtgtgcaaagtcctacacctcgaaggagaagtgaacaaaatcaaatcagccctactctccaccaacaaggccgtcgtctccctctccggctgcggtgtctccgtcctaaccttcaaagtgctagacctcaagaactacatcgacaaacaactcctaccaatactcaacaagcaatcttgctccatctccaacatcgaaaccgtaatcgagttccaacagaagaacaaccgcctcctcgaaatcacccgcgagttctctgtcaacgcaggggtcaccactcccgtctccacatacatgctcacaaactccgaactcctcagcctcatcaacgacatgcccataaccaacgaccagaaaaagctaatgagcaataacgtccaaatcgttagacaacaaagttattccatcatgtgcatcatcaaagaagaagtcctcgcctacgtcgtacaactccccctctatggcgtcatcgacaccccctgctggaaactgcacacatcacccctctgcaccacaaacaccaaagaaggctcaaacatctgcctaactcgcaccgaccgcggctggtactgcgacaacgccggcagcgtatcattctttccccaagccgaaacatgcaaagttcaatccaaccgcgtcttctgcgacacaatgaactccagaacgctccccagcgaagtcaacctctgtaacgtagacatcttcaaccctaagtacgactgcaaaatcatgacctccaaaactgatgtatcctcctccgtcatcacatccctgggcgccatcgtcagctgctacggcaaaacaaaatgcactgcctcaaacaaatgccgaggtatcataaagaccttctcaaacggatgcgattacgtcagcaacaaaggcgtcgacaccgtcagtgtcggcaacaccctctactacgtcaacaaacaagaaggaaaatccctctacgtcaaaggcgaacccatcatcaacttctacgaccccctcgtcttccccagcgacgagttcgacgcctccatctcacaagtcaacgaaaagataaaccaatctctagccttcatccgcaaatccgatgaactcctgcataacgtcaacgccggcaaatccaccacaaacatcatgatcactaccataatcatcgtcataatcgtaatcctcctatctcttatcgcagtcggcctactactctactgcaaagcccgctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5912 - RNA, 2133 nt, synthetic construct
  misc_feature 1..2133: note = mRNA product Design f-1 comprising derived and/or modified sequence from HRSV(A2)__F-del_DSCav1_mut5 (opt1)
  source 1..2133: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5913 - RNA, 2133 nt, synthetic construct
  misc_feature 1..2133: note = mRNA product Design f-1 comprising derived and/or modified sequence from HRSV(A2)__F-del_DSCav1_mut5 (opt1)
  source 1..2133: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcgggtgcggcgtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggggtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggcgtgatcgacacgccgtgctggaagctgcacaccagccccctctgcaccaccaacacgaaggaggggtccaacatctgcctgacccgcaccgaccggggctggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggggccatcgtgtcctgctacggcaagaccaagtgcaccgccagcaacaagtgccgggggatcatcaagaccttctccaacggctgcgactacgtgagcaacaagggcgtcgacacggtgagcgtggggaacaccctctactacgtcaacaagcaggagggcaagtccctgtacgtgaagggggagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccggcaagtccaccaccaacatcatgatcaccacgatcatcatcgtgatcatcgtcatcctcctgagcctgatcgccgtggggctcctgctgtactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5914 - RNA, 2133 nt, synthetic construct
  misc_feature 1..2133: note = mRNA product Design f-1 comprising derived and/or modified sequence from HRSV(A2)__F-del_DSCav1_mut5 (opt2)
  source 1..2133: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5915 - RNA, 2133 nt, synthetic construct
  misc_feature 1..2133: note = mRNA product Design f-1 comprising derived and/or modified sequence from HRSV(A2)__F-del_DSCav1_mut5 (opt3)
  source 1..2133: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcggttgcggggtgtccgtattaacttttaaggttctggaccttaagaactacattgataaacaattgctgcctatcctaaataagcagtcatgtagtattagcaacatcgagaccgtgatagagttccagcagaaaaataacaggctcctggaaattacacgggagttttctgtcaatgcgggagtgactaccccagtgtccacatatatgcttaccaactcagaactgttgagcctcatcaatgacatgccgattacgaacgatcaaaagaaactgatgagtaacaatgtccagatcgttcgccagcagtcttactccatcatgtgcattataaaggaggaagtgttagcatatgtagtgcaactgcccctctacggcgtcatcgacactccttgttggaaacttcatacaagcccactgtgcaccactaacacaaaggagggctcgaatatttgtttgacccgaacggatcgtgggtggtactgcgacaacgccggatctgtgtccttctttccccaggctgaaacctgtaaggttcagtcaaatagagtgttctgcgatacaatgaacagtagaactctgcctagcgaggtcaatctctgcaacgtggacatctttaatccaaaatatgattgtaagataatgacctccaaaacagacgtatctagctcagttattaccagtctgggtgccatcgtgtcctgctacggcaagactaaatgtacagcaagcaacaagtgcagggggatcattaagaccttctctaatggatgtgattatgtctcaaacaaaggcgtggacactgtcagtgtgggtaatacgctttactatgttaacaagcaagaggggaaaagcctgtacgtgaagggagaacccatcattaatttttatgaccctttggtattcccatccgatgagtttgacgcttctatatcgcaggtcaacgagaaaatcaaccagagcctcgccttcattcggaagtccgatgaactgttacacaatgtgaacgcgggcaagtcaacaaccaatatcatgatcactaccattataatcgttattatcgtgattctgctaagtctcatcgccgtcggcctgcttttgtactgcaaagcacgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5916 - RNA, 2133 nt, synthetic construct
  misc_feature 1..2133: note = mRNA product Design f-1 comprising derived and/or modified sequence from HRSV(A2)__F-del_DSCav1_mut5 (opt4)
  source 1..2133: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5917 - RNA, 2133 nt, synthetic construct
  misc_feature 1..2133: note = mRNA product Design f-1 comprising derived and/or modified sequence from HRSV(A2)__F-del_DSCav1_mut5 (opt5)
  source 1..2133: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcggatgcggcgtttctgtgctgacatttaaggtccttgacctgaagaactacattgataaacaactcctgcctatcctgaataagcagtcctgtagcatttctaacatcgagaccgtgattgagttccagcagaaaaataaccggctcctggaaatcacgcgcgagttttccgtgaatgccggcgtcacaaccccggttagcacatatatgcttaccaactccgaactgctctctctgatcaatgacatgcccattaccaacgatcaaaagaaacttatgagcaacaatgtgcagatcgtgagacagcagtcctacagcattatgtgcatcattaaggaggaagtcctggcttatgtggttcaactccctctgtacggggtgatcgacacaccctgttggaaactgcatacgtctcctctctgcaccacaaacaccaaggagggatccaatatctgtctgacacggaccgatcgcggctggtactgcgacaacgccgggagcgtctctttctttccccaggcggaaacgtgtaaggtgcagagcaatagagttttctgcgatacaatgaactccagaaccctgccttctgaggtgaatctctgcaacgtcgacatttttaatccgaaatatgattgtaagatcatgaccagcaaaacagacgtgtccagctctgtcattacctccctgggagccatcgtgagctgctacggcaagacaaaatgtacggcttctaacaagtgccgggggattatcaagaccttctccaatggatgtgattatgttagcaacaaaggcgtggacacagtctccgtgggcaataccctttactatgttaacaagcaagaggggaaatctctgtacgtgaagggagaacccatcattaatttttatgaccctctcgtcttccccagcgatgagtttgacgcctccatctctcaggtgaacgagaaaattaaccagagcctggctttcatccgcaagtccgatgaactgctccacaatgtgaacgccggcaagagcacaaccaatattatgatcacgaccattatcatcgttattatcgtcattctgctttctctgatcgccgtggggctcctgctgtactgcaaagctagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5918 - RNA, 2133 nt, synthetic construct
  misc_feature 1..2133: note = mRNA product Design f-1 comprising derived and/or modified sequence from HRSV(A2)__F-del_DSCav1_mut5 (opt6)
  source 1..2133: mol_type = other RNA
gggagagcggctcggccattttgtcccagtcagtccggaggctgcggctgcagaagtaccgcctgcggagtaactgcaaagaagcttaccatggaacttttaatactgaaagcaaatgccatcacaaccatactaactgccgtcacattctgctttgcatcaggacaaaacataacagaagaattttaccaatccacatgctcagcagtatcaaaaggatatctatcggcacttagaactggatggtacacaagtgttataactatagaactctcaaacataaaagaaaacaaatgcaatggaacagacgcaaaagtaaaactaataaaacaagaactcgataaatataaaaatgcagtaaccgaactacaactattaatgcaaagcacacccgcaacaggcagcggatcagcaatagcaagcggagtcgcagtatgtaaagtactacatctagaaggagaagtcaacaaaatcaaatctgcacttctatccacaaacaaagctgtagtatccctatccggatgcggagtctcagtattaacttttaaagtactagaccttaaaaactacatagataaacaactattaccaatactaaataaacaatcatgcagcatatccaatatagagacagtaattgaatttcaacaaaaaaacaacagattactagaaattactcgtgaattttccgtaaatgccggagtcacaacaccagtatcaacctatatgctaacaaacagcgaactacttagcttaataaatgacatgccaataacaaatgaccaaaaaaaacttatgtcaaataacgtacaaatcgtcagacaacaatcctactctataatgtgtataattaaagaagaagtcctagcatacgtagttcaattaccactctatggagtaatagatacaccatgctggaaactacacacgtcaccactatgtacaacaaacacaaaagaaggatccaatatatgcctaacaagaaccgacagaggctggtattgtgacaacgcaggatccgtttcattcttcccacaagcagaaacctgtaaagtacaatctaatagagtattttgcgacacaatgaacagtagaacactaccaagcgaggttaatctatgtaacgtagacatattcaatccaaaatatgattgcaaaataatgacatcaaaaacagatgtatcgtcgagtgtaataacaagtctgggagctatagtaagctgctacggcaagacgaaatgtaccgcttcaaataaatgcagaggaatcattaaaacattctcgaacggatgcgactacgtaagtaataaaggtgtcgacaccgtatcagtagggaatacattatactacgtcaacaaacaagaaggaaaatctctatatgtaaaaggagaaccaataataaatttctatgaccctctagtattcccatcagatgaatttgacgcttccatatcacaagtaaacgaaaaaatcaatcaatctttagcattcatacgaaaaagtgatgaactcctacacaacgtcaacgcaggaaaaagcacaacaaatataatgatcacaacaatcatcatagtaataatagtaatactactatcattaatagcagtaggattattgctttactgcaaagcacgatagggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5919 - RNA, 2133 nt, synthetic construct
  misc_feature 1..2133: note = mRNA product Design f-1 comprising derived and/or modified sequence from HRSV(A2)__F-del_DSCav1_mut5 (opt11)
  source 1..2133: mol_type = other RNA
gggagagcggctcggccattttgtcccagtcagtccggaggctgcggctgcagaagtaccgcctgcggagtaactgcaaagaagcttaccatggaactcctcatcctcaaagccaacgccataaccacaatactcaccgccgtaaccttctgctttgcgtcgggacaaaacatcaccgaagagttctaccaatccacttgctccgcagtaagcaaaggatacctctccgccctgcgaaccggttggtacacatcagtcatcacaatcgaactctcaaacataaaagaaaacaaatgcaacggcaccgacgcaaaggtcaaattaatcaagcaagaactagacaaatacaaaaacgccgtcacagaactccagctgctaatgcagagcacacccgcaactggcagcggatccgccatcgcatcaggagtcgccgtgtgcaaagtcctacacctcgaaggagaagtgaacaaaatcaaatcagccctactctccaccaacaaggccgtcgtctccctctccggctgcggtgtctccgtcctaaccttcaaagtgctagacctcaagaactacatcgacaaacaactcctaccaatactcaacaagcaatcttgctccatctccaacatcgaaaccgtaatcgagttccaacagaagaacaaccgcctcctcgaaatcacccgcgagttctctgtcaacgcaggggtcaccactcccgtctccacatacatgctcacaaactccgaactcctcagcctcatcaacgacatgcccataaccaacgaccagaaaaagctaatgagcaataacgtccaaatcgttagacaacaaagttattccatcatgtgcatcatcaaagaagaagtcctcgcctacgtcgtacaactccccctctatggcgtcatcgacaccccctgctggaaactgcacacatcacccctctgcaccacaaacaccaaagaaggctcaaacatctgcctaactcgcaccgaccgcggctggtactgcgacaacgccggcagcgtatcattctttccccaagccgaaacatgcaaagttcaatccaaccgcgtcttctgcgacacaatgaactccagaacgctccccagcgaagtcaacctctgtaacgtagacatcttcaaccctaagtacgactgcaaaatcatgacctccaaaactgatgtatcctcctccgtcatcacatccctgggcgccatcgtcagctgctacggcaaaacaaaatgcactgcctcaaacaaatgccgaggtatcataaagaccttctcaaacggatgcgattacgtcagcaacaaaggcgtcgacaccgtcagtgtcggcaacaccctctactacgtcaacaaacaagaaggaaaatccctctacgtcaaaggcgaacccatcatcaacttctacgaccccctcgtcttccccagcgacgagttcgacgcctccatctcacaagtcaacgaaaagataaaccaatctctagccttcatccgcaaatccgatgaactcctgcataacgtcaacgccggcaaatccaccacaaacatcatgatcactaccataatcatcgtcataatcgtaatcctcctatctcttatcgcagtcggcctactactctactgcaaagcccgctaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5920 - RNA, 1913 nt, synthetic construct
  misc_feature 1..1913: note = mRNA product Design f-2 comprising derived and/or modified sequence from HRSV(A2)__F-del_DSCav1_mut5 (opt1)
  source 1..1913: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5921 - RNA, 1913 nt, synthetic construct
  misc_feature 1..1913: note = mRNA product Design f-2 comprising derived and/or modified sequence from HRSV(A2)__F-del_DSCav1_mut5 (opt1)
  source 1..1913: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcgggtgcggcgtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggggtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggcgtgatcgacacgccgtgctggaagctgcacaccagccccctctgcaccaccaacacgaaggaggggtccaacatctgcctgacccgcaccgaccggggctggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggggccatcgtgtcctgctacggcaagaccaagtgcaccgccagcaacaagtgccgggggatcatcaagaccttctccaacggctgcgactacgtgagcaacaagggcgtcgacacggtgagcgtggggaacaccctctactacgtcaacaagcaggagggcaagtccctgtacgtgaagggggagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccggcaagtccaccaccaacatcatgatcaccacgatcatcatcgtgatcatcgtcatcctcctgagcctgatcgccgtggggctcctgctgtactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5922 - RNA, 1913 nt, synthetic construct
  misc_feature 1..1913: note = mRNA product Design f-2 comprising derived and/or modified sequence from HRSV(A2)__F-del_DSCav1_mut5 (opt2)
  source 1..1913: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5923 - RNA, 1913 nt, synthetic construct
  misc_feature 1..1913: note = mRNA product Design f-2 comprising derived and/or modified sequence from HRSV(A2)__F-del_DSCav1_mut5 (opt3)
  source 1..1913: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcggttgcggggtgtccgtattaacttttaaggttctggaccttaagaactacattgataaacaattgctgcctatcctaaataagcagtcatgtagtattagcaacatcgagaccgtgatagagttccagcagaaaaataacaggctcctggaaattacacgggagttttctgtcaatgcgggagtgactaccccagtgtccacatatatgcttaccaactcagaactgttgagcctcatcaatgacatgccgattacgaacgatcaaaagaaactgatgagtaacaatgtccagatcgttcgccagcagtcttactccatcatgtgcattataaaggaggaagtgttagcatatgtagtgcaactgcccctctacggcgtcatcgacactccttgttggaaacttcatacaagcccactgtgcaccactaacacaaaggagggctcgaatatttgtttgacccgaacggatcgtgggtggtactgcgacaacgccggatctgtgtccttctttccccaggctgaaacctgtaaggttcagtcaaatagagtgttctgcgatacaatgaacagtagaactctgcctagcgaggtcaatctctgcaacgtggacatctttaatccaaaatatgattgtaagataatgacctccaaaacagacgtatctagctcagttattaccagtctgggtgccatcgtgtcctgctacggcaagactaaatgtacagcaagcaacaagtgcagggggatcattaagaccttctctaatggatgtgattatgtctcaaacaaaggcgtggacactgtcagtgtgggtaatacgctttactatgttaacaagcaagaggggaaaagcctgtacgtgaagggagaacccatcattaatttttatgaccctttggtattcccatccgatgagtttgacgcttctatatcgcaggtcaacgagaaaatcaaccagagcctcgccttcattcggaagtccgatgaactgttacacaatgtgaacgcgggcaagtcaacaaccaatatcatgatcactaccattataatcgttattatcgtgattctgctaagtctcatcgccgtcggcctgcttttgtactgcaaagcacgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5924 - RNA, 1913 nt, synthetic construct
  misc_feature 1..1913: note = mRNA product Design f-2 comprising derived and/or modified sequence from HRSV(A2)__F-del_DSCav1_mut5 (opt4)
  source 1..1913: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5925 - RNA, 1913 nt, synthetic construct
  misc_feature 1..1913: note = mRNA product Design f-2 comprising derived and/or modified sequence from HRSV(A2)__F-del_DSCav1_mut5 (opt5)
  source 1..1913: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcggatgcggcgtttctgtgctgacatttaaggtccttgacctgaagaactacattgataaacaactcctgcctatcctgaataagcagtcctgtagcatttctaacatcgagaccgtgattgagttccagcagaaaaataaccggctcctggaaatcacgcgcgagttttccgtgaatgccggcgtcacaaccccggttagcacatatatgcttaccaactccgaactgctctctctgatcaatgacatgcccattaccaacgatcaaaagaaacttatgagcaacaatgtgcagatcgtgagacagcagtcctacagcattatgtgcatcattaaggaggaagtcctggcttatgtggttcaactccctctgtacggggtgatcgacacaccctgttggaaactgcatacgtctcctctctgcaccacaaacaccaaggagggatccaatatctgtctgacacggaccgatcgcggctggtactgcgacaacgccgggagcgtctctttctttccccaggcggaaacgtgtaaggtgcagagcaatagagttttctgcgatacaatgaactccagaaccctgccttctgaggtgaatctctgcaacgtcgacatttttaatccgaaatatgattgtaagatcatgaccagcaaaacagacgtgtccagctctgtcattacctccctgggagccatcgtgagctgctacggcaagacaaaatgtacggcttctaacaagtgccgggggattatcaagaccttctccaatggatgtgattatgttagcaacaaaggcgtggacacagtctccgtgggcaataccctttactatgttaacaagcaagaggggaaatctctgtacgtgaagggagaacccatcattaatttttatgaccctctcgtcttccccagcgatgagtttgacgcctccatctctcaggtgaacgagaaaattaaccagagcctggctttcatccgcaagtccgatgaactgctccacaatgtgaacgccggcaagagcacaaccaatattatgatcacgaccattatcatcgttattatcgtcattctgctttctctgatcgccgtggggctcctgctgtactgcaaagctagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5926 - RNA, 1913 nt, synthetic construct
  misc_feature 1..1913: note = mRNA product Design f-2 comprising derived and/or modified sequence from HRSV(A2)__F-del_DSCav1_mut5 (opt6)
  source 1..1913: mol_type = other RNA
gggagagcggctcggccattttgtcccagtcagtccggaggctgcggctgcagaagtaccgcctgcggagtaactgcaaagaagcttaccatggaacttttaatactgaaagcaaatgccatcacaaccatactaactgccgtcacattctgctttgcatcaggacaaaacataacagaagaattttaccaatccacatgctcagcagtatcaaaaggatatctatcggcacttagaactggatggtacacaagtgttataactatagaactctcaaacataaaagaaaacaaatgcaatggaacagacgcaaaagtaaaactaataaaacaagaactcgataaatataaaaatgcagtaaccgaactacaactattaatgcaaagcacacccgcaacaggcagcggatcagcaatagcaagcggagtcgcagtatgtaaagtactacatctagaaggagaagtcaacaaaatcaaatctgcacttctatccacaaacaaagctgtagtatccctatccggatgcggagtctcagtattaacttttaaagtactagaccttaaaaactacatagataaacaactattaccaatactaaataaacaatcatgcagcatatccaatatagagacagtaattgaatttcaacaaaaaaacaacagattactagaaattactcgtgaattttccgtaaatgccggagtcacaacaccagtatcaacctatatgctaacaaacagcgaactacttagcttaataaatgacatgccaataacaaatgaccaaaaaaaacttatgtcaaataacgtacaaatcgtcagacaacaatcctactctataatgtgtataattaaagaagaagtcctagcatacgtagttcaattaccactctatggagtaatagatacaccatgctggaaactacacacgtcaccactatgtacaacaaacacaaaagaaggatccaatatatgcctaacaagaaccgacagaggctggtattgtgacaacgcaggatccgtttcattcttcccacaagcagaaacctgtaaagtacaatctaatagagtattttgcgacacaatgaacagtagaacactaccaagcgaggttaatctatgtaacgtagacatattcaatccaaaatatgattgcaaaataatgacatcaaaaacagatgtatcgtcgagtgtaataacaagtctgggagctatagtaagctgctacggcaagacgaaatgtaccgcttcaaataaatgcagaggaatcattaaaacattctcgaacggatgcgactacgtaagtaataaaggtgtcgacaccgtatcagtagggaatacattatactacgtcaacaaacaagaaggaaaatctctatatgtaaaaggagaaccaataataaatttctatgaccctctagtattcccatcagatgaatttgacgcttccatatcacaagtaaacgaaaaaatcaatcaatctttagcattcatacgaaaaagtgatgaactcctacacaacgtcaacgcaggaaaaagcacaacaaatataatgatcacaacaatcatcatagtaataatagtaatactactatcattaatagcagtaggattattgctttactgcaaagcacgatagggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5927 - RNA, 1913 nt, synthetic construct
  misc_feature 1..1913: note = mRNA product Design f-2 comprising derived and/or modified sequence from HRSV(A2)__F-del_DSCav1_mut5 (opt11)
  source 1..1913: mol_type = other RNA
gggagagcggctcggccattttgtcccagtcagtccggaggctgcggctgcagaagtaccgcctgcggagtaactgcaaagaagcttaccatggaactcctcatcctcaaagccaacgccataaccacaatactcaccgccgtaaccttctgctttgcgtcgggacaaaacatcaccgaagagttctaccaatccacttgctccgcagtaagcaaaggatacctctccgccctgcgaaccggttggtacacatcagtcatcacaatcgaactctcaaacataaaagaaaacaaatgcaacggcaccgacgcaaaggtcaaattaatcaagcaagaactagacaaatacaaaaacgccgtcacagaactccagctgctaatgcagagcacacccgcaactggcagcggatccgccatcgcatcaggagtcgccgtgtgcaaagtcctacacctcgaaggagaagtgaacaaaatcaaatcagccctactctccaccaacaaggccgtcgtctccctctccggctgcggtgtctccgtcctaaccttcaaagtgctagacctcaagaactacatcgacaaacaactcctaccaatactcaacaagcaatcttgctccatctccaacatcgaaaccgtaatcgagttccaacagaagaacaaccgcctcctcgaaatcacccgcgagttctctgtcaacgcaggggtcaccactcccgtctccacatacatgctcacaaactccgaactcctcagcctcatcaacgacatgcccataaccaacgaccagaaaaagctaatgagcaataacgtccaaatcgttagacaacaaagttattccatcatgtgcatcatcaaagaagaagtcctcgcctacgtcgtacaactccccctctatggcgtcatcgacaccccctgctggaaactgcacacatcacccctctgcaccacaaacaccaaagaaggctcaaacatctgcctaactcgcaccgaccgcggctggtactgcgacaacgccggcagcgtatcattctttccccaagccgaaacatgcaaagttcaatccaaccgcgtcttctgcgacacaatgaactccagaacgctccccagcgaagtcaacctctgtaacgtagacatcttcaaccctaagtacgactgcaaaatcatgacctccaaaactgatgtatcctcctccgtcatcacatccctgggcgccatcgtcagctgctacggcaaaacaaaatgcactgcctcaaacaaatgccgaggtatcataaagaccttctcaaacggatgcgattacgtcagcaacaaaggcgtcgacaccgtcagtgtcggcaacaccctctactacgtcaacaaacaagaaggaaaatccctctacgtcaaaggcgaacccatcatcaacttctacgaccccctcgtcttccccagcgacgagttcgacgcctccatctcacaagtcaacgaaaagataaaccaatctctagccttcatccgcaaatccgatgaactcctgcataacgtcaacgccggcaaatccaccacaaacatcatgatcactaccataatcatcgtcataatcgtaatcctcctatctcttatcgcagtcggcctactactctactgcaaagcccgctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5928 - RNA, 1904 nt, synthetic construct
  misc_feature 1..1904: note = mRNA product Design f-3 comprising derived and/or modified sequence from HRSV(A2)__F-del_DSCav1_mut5 (opt1)
  source 1..1904: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5929 - RNA, 1904 nt, synthetic construct
  misc_feature 1..1904: note = mRNA product Design f-3 comprising derived and/or modified sequence from HRSV(A2)__F-del_DSCav1_mut5 (opt1)
  source 1..1904: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcgggtgcggcgtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggggtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggcgtgatcgacacgccgtgctggaagctgcacaccagccccctctgcaccaccaacacgaaggaggggtccaacatctgcctgacccgcaccgaccggggctggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggggccatcgtgtcctgctacggcaagaccaagtgcaccgccagcaacaagtgccgggggatcatcaagaccttctccaacggctgcgactacgtgagcaacaagggcgtcgacacggtgagcgtggggaacaccctctactacgtcaacaagcaggagggcaagtccctgtacgtgaagggggagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccggcaagtccaccaccaacatcatgatcaccacgatcatcatcgtgatcatcgtcatcctcctgagcctgatcgccgtggggctcctgctgtactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5930 - RNA, 1904 nt, synthetic construct
  misc_feature 1..1904: note = mRNA product Design f-3 comprising derived and/or modified sequence from HRSV(A2)__F-del_DSCav1_mut5 (opt2)
  source 1..1904: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5931 - RNA, 1904 nt, synthetic construct
  misc_feature 1..1904: note = mRNA product Design f-3 comprising derived and/or modified sequence from HRSV(A2)__F-del_DSCav1_mut5 (opt3)
  source 1..1904: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcggttgcggggtgtccgtattaacttttaaggttctggaccttaagaactacattgataaacaattgctgcctatcctaaataagcagtcatgtagtattagcaacatcgagaccgtgatagagttccagcagaaaaataacaggctcctggaaattacacgggagttttctgtcaatgcgggagtgactaccccagtgtccacatatatgcttaccaactcagaactgttgagcctcatcaatgacatgccgattacgaacgatcaaaagaaactgatgagtaacaatgtccagatcgttcgccagcagtcttactccatcatgtgcattataaaggaggaagtgttagcatatgtagtgcaactgcccctctacggcgtcatcgacactccttgttggaaacttcatacaagcccactgtgcaccactaacacaaaggagggctcgaatatttgtttgacccgaacggatcgtgggtggtactgcgacaacgccggatctgtgtccttctttccccaggctgaaacctgtaaggttcagtcaaatagagtgttctgcgatacaatgaacagtagaactctgcctagcgaggtcaatctctgcaacgtggacatctttaatccaaaatatgattgtaagataatgacctccaaaacagacgtatctagctcagttattaccagtctgggtgccatcgtgtcctgctacggcaagactaaatgtacagcaagcaacaagtgcagggggatcattaagaccttctctaatggatgtgattatgtctcaaacaaaggcgtggacactgtcagtgtgggtaatacgctttactatgttaacaagcaagaggggaaaagcctgtacgtgaagggagaacccatcattaatttttatgaccctttggtattcccatccgatgagtttgacgcttctatatcgcaggtcaacgagaaaatcaaccagagcctcgccttcattcggaagtccgatgaactgttacacaatgtgaacgcgggcaagtcaacaaccaatatcatgatcactaccattataatcgttattatcgtgattctgctaagtctcatcgccgtcggcctgcttttgtactgcaaagcacgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5932 - RNA, 1904 nt, synthetic construct
  misc_feature 1..1904: note = mRNA product Design f-3 comprising derived and/or modified sequence from HRSV(A2)__F-del_DSCav1_mut5 (opt4)
  source 1..1904: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5933 - RNA, 1904 nt, synthetic construct
  misc_feature 1..1904: note = mRNA product Design f-3 comprising derived and/or modified sequence from HRSV(A2)__F-del_DSCav1_mut5 (opt5)
  source 1..1904: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcggatgcggcgtttctgtgctgacatttaaggtccttgacctgaagaactacattgataaacaactcctgcctatcctgaataagcagtcctgtagcatttctaacatcgagaccgtgattgagttccagcagaaaaataaccggctcctggaaatcacgcgcgagttttccgtgaatgccggcgtcacaaccccggttagcacatatatgcttaccaactccgaactgctctctctgatcaatgacatgcccattaccaacgatcaaaagaaacttatgagcaacaatgtgcagatcgtgagacagcagtcctacagcattatgtgcatcattaaggaggaagtcctggcttatgtggttcaactccctctgtacggggtgatcgacacaccctgttggaaactgcatacgtctcctctctgcaccacaaacaccaaggagggatccaatatctgtctgacacggaccgatcgcggctggtactgcgacaacgccgggagcgtctctttctttccccaggcggaaacgtgtaaggtgcagagcaatagagttttctgcgatacaatgaactccagaaccctgccttctgaggtgaatctctgcaacgtcgacatttttaatccgaaatatgattgtaagatcatgaccagcaaaacagacgtgtccagctctgtcattacctccctgggagccatcgtgagctgctacggcaagacaaaatgtacggcttctaacaagtgccgggggattatcaagaccttctccaatggatgtgattatgttagcaacaaaggcgtggacacagtctccgtgggcaataccctttactatgttaacaagcaagaggggaaatctctgtacgtgaagggagaacccatcattaatttttatgaccctctcgtcttccccagcgatgagtttgacgcctccatctctcaggtgaacgagaaaattaaccagagcctggctttcatccgcaagtccgatgaactgctccacaatgtgaacgccggcaagagcacaaccaatattatgatcacgaccattatcatcgttattatcgtcattctgctttctctgatcgccgtggggctcctgctgtactgcaaagctagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5934 - RNA, 1904 nt, synthetic construct
  misc_feature 1..1904: note = mRNA product Design f-3 comprising derived and/or modified sequence from HRSV(A2)__F-del_DSCav1_mut5 (opt6)
  source 1..1904: mol_type = other RNA
gggagagtcccgcagtcggcgtccagcggctctgcttgttcgtgtgtgtgtcgttgcaggccttattcaagcttaccatggaacttttaatactgaaagcaaatgccatcacaaccatactaactgccgtcacattctgctttgcatcaggacaaaacataacagaagaattttaccaatccacatgctcagcagtatcaaaaggatatctatcggcacttagaactggatggtacacaagtgttataactatagaactctcaaacataaaagaaaacaaatgcaatggaacagacgcaaaagtaaaactaataaaacaagaactcgataaatataaaaatgcagtaaccgaactacaactattaatgcaaagcacacccgcaacaggcagcggatcagcaatagcaagcggagtcgcagtatgtaaagtactacatctagaaggagaagtcaacaaaatcaaatctgcacttctatccacaaacaaagctgtagtatccctatccggatgcggagtctcagtattaacttttaaagtactagaccttaaaaactacatagataaacaactattaccaatactaaataaacaatcatgcagcatatccaatatagagacagtaattgaatttcaacaaaaaaacaacagattactagaaattactcgtgaattttccgtaaatgccggagtcacaacaccagtatcaacctatatgctaacaaacagcgaactacttagcttaataaatgacatgccaataacaaatgaccaaaaaaaacttatgtcaaataacgtacaaatcgtcagacaacaatcctactctataatgtgtataattaaagaagaagtcctagcatacgtagttcaattaccactctatggagtaatagatacaccatgctggaaactacacacgtcaccactatgtacaacaaacacaaaagaaggatccaatatatgcctaacaagaaccgacagaggctggtattgtgacaacgcaggatccgtttcattcttcccacaagcagaaacctgtaaagtacaatctaatagagtattttgcgacacaatgaacagtagaacactaccaagcgaggttaatctatgtaacgtagacatattcaatccaaaatatgattgcaaaataatgacatcaaaaacagatgtatcgtcgagtgtaataacaagtctgggagctatagtaagctgctacggcaagacgaaatgtaccgcttcaaataaatgcagaggaatcattaaaacattctcgaacggatgcgactacgtaagtaataaaggtgtcgacaccgtatcagtagggaatacattatactacgtcaacaaacaagaaggaaaatctctatatgtaaaaggagaaccaataataaatttctatgaccctctagtattcccatcagatgaatttgacgcttccatatcacaagtaaacgaaaaaatcaatcaatctttagcattcatacgaaaaagtgatgaactcctacacaacgtcaacgcaggaaaaagcacaacaaatataatgatcacaacaatcatcatagtaataatagtaatactactatcattaatagcagtaggattattgctttactgcaaagcacgatagggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5935 - RNA, 1904 nt, synthetic construct
  misc_feature 1..1904: note = mRNA product Design f-3 comprising derived and/or modified sequence from HRSV(A2)__F-del_DSCav1_mut5 (opt11)
  source 1..1904: mol_type = other RNA
gggagagtcccgcagtcggcgtccagcggctctgcttgttcgtgtgtgtgtcgttgcaggccttattcaagcttaccatggaactcctcatcctcaaagccaacgccataaccacaatactcaccgccgtaaccttctgctttgcgtcgggacaaaacatcaccgaagagttctaccaatccacttgctccgcagtaagcaaaggatacctctccgccctgcgaaccggttggtacacatcagtcatcacaatcgaactctcaaacataaaagaaaacaaatgcaacggcaccgacgcaaaggtcaaattaatcaagcaagaactagacaaatacaaaaacgccgtcacagaactccagctgctaatgcagagcacacccgcaactggcagcggatccgccatcgcatcaggagtcgccgtgtgcaaagtcctacacctcgaaggagaagtgaacaaaatcaaatcagccctactctccaccaacaaggccgtcgtctccctctccggctgcggtgtctccgtcctaaccttcaaagtgctagacctcaagaactacatcgacaaacaactcctaccaatactcaacaagcaatcttgctccatctccaacatcgaaaccgtaatcgagttccaacagaagaacaaccgcctcctcgaaatcacccgcgagttctctgtcaacgcaggggtcaccactcccgtctccacatacatgctcacaaactccgaactcctcagcctcatcaacgacatgcccataaccaacgaccagaaaaagctaatgagcaataacgtccaaatcgttagacaacaaagttattccatcatgtgcatcatcaaagaagaagtcctcgcctacgtcgtacaactccccctctatggcgtcatcgacaccccctgctggaaactgcacacatcacccctctgcaccacaaacaccaaagaaggctcaaacatctgcctaactcgcaccgaccgcggctggtactgcgacaacgccggcagcgtatcattctttccccaagccgaaacatgcaaagttcaatccaaccgcgtcttctgcgacacaatgaactccagaacgctccccagcgaagtcaacctctgtaacgtagacatcttcaaccctaagtacgactgcaaaatcatgacctccaaaactgatgtatcctcctccgtcatcacatccctgggcgccatcgtcagctgctacggcaaaacaaaatgcactgcctcaaacaaatgccgaggtatcataaagaccttctcaaacggatgcgattacgtcagcaacaaaggcgtcgacaccgtcagtgtcggcaacaccctctactacgtcaacaaacaagaaggaaaatccctctacgtcaaaggcgaacccatcatcaacttctacgaccccctcgtcttccccagcgacgagttcgacgcctccatctcacaagtcaacgaaaagataaaccaatctctagccttcatccgcaaatccgatgaactcctgcataacgtcaacgccggcaaatccaccacaaacatcatgatcactaccataatcatcgtcataatcgtaatcctcctatctcttatcgcagtcggcctactactctactgcaaagcccgctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5936 - RNA, 2120 nt, synthetic construct
  misc_feature 1..2120: note = mRNA product Design f-4 comprising derived and/or modified sequence from HRSV(A2)__F-del_DSCav1_mut5 (opt1)
  source 1..2120: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5937 - RNA, 2120 nt, synthetic construct
  misc_feature 1..2120: note = mRNA product Design f-4 comprising derived and/or modified sequence from HRSV(A2)__F-del_DSCav1_mut5 (opt1)
  source 1..2120: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcgggtgcggcgtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggggtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggcgtgatcgacacgccgtgctggaagctgcacaccagccccctctgcaccaccaacacgaaggaggggtccaacatctgcctgacccgcaccgaccggggctggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggggccatcgtgtcctgctacggcaagaccaagtgcaccgccagcaacaagtgccgggggatcatcaagaccttctccaacggctgcgactacgtgagcaacaagggcgtcgacacggtgagcgtggggaacaccctctactacgtcaacaagcaggagggcaagtccctgtacgtgaagggggagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccggcaagtccaccaccaacatcatgatcaccacgatcatcatcgtgatcatcgtcatcctcctgagcctgatcgccgtggggctcctgctgtactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5938 - RNA, 2120 nt, synthetic construct
  misc_feature 1..2120: note = mRNA product Design f-4 comprising derived and/or modified sequence from HRSV(A2)__F-del_DSCav1_mut5 (opt2)
  source 1..2120: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5939 - RNA, 2120 nt, synthetic construct
  misc_feature 1..2120: note = mRNA product Design f-4 comprising derived and/or modified sequence from HRSV(A2)__F-del_DSCav1_mut5 (opt3)
  source 1..2120: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcggttgcggggtgtccgtattaacttttaaggttctggaccttaagaactacattgataaacaattgctgcctatcctaaataagcagtcatgtagtattagcaacatcgagaccgtgatagagttccagcagaaaaataacaggctcctggaaattacacgggagttttctgtcaatgcgggagtgactaccccagtgtccacatatatgcttaccaactcagaactgttgagcctcatcaatgacatgccgattacgaacgatcaaaagaaactgatgagtaacaatgtccagatcgttcgccagcagtcttactccatcatgtgcattataaaggaggaagtgttagcatatgtagtgcaactgcccctctacggcgtcatcgacactccttgttggaaacttcatacaagcccactgtgcaccactaacacaaaggagggctcgaatatttgtttgacccgaacggatcgtgggtggtactgcgacaacgccggatctgtgtccttctttccccaggctgaaacctgtaaggttcagtcaaatagagtgttctgcgatacaatgaacagtagaactctgcctagcgaggtcaatctctgcaacgtggacatctttaatccaaaatatgattgtaagataatgacctccaaaacagacgtatctagctcagttattaccagtctgggtgccatcgtgtcctgctacggcaagactaaatgtacagcaagcaacaagtgcagggggatcattaagaccttctctaatggatgtgattatgtctcaaacaaaggcgtggacactgtcagtgtgggtaatacgctttactatgttaacaagcaagaggggaaaagcctgtacgtgaagggagaacccatcattaatttttatgaccctttggtattcccatccgatgagtttgacgcttctatatcgcaggtcaacgagaaaatcaaccagagcctcgccttcattcggaagtccgatgaactgttacacaatgtgaacgcgggcaagtcaacaaccaatatcatgatcactaccattataatcgttattatcgtgattctgctaagtctcatcgccgtcggcctgcttttgtactgcaaagcacgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5940 - RNA, 2120 nt, synthetic construct
  misc_feature 1..2120: note = mRNA product Design f-4 comprising derived and/or modified sequence from HRSV(A2)__F-del_DSCav1_mut5 (opt4)
  source 1..2120: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5941 - RNA, 2120 nt, synthetic construct
  misc_feature 1..2120: note = mRNA product Design f-4 comprising derived and/or modified sequence from HRSV(A2)__F-del_DSCav1_mut5 (opt5)
  source 1..2120: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcggatgcggcgtttctgtgctgacatttaaggtccttgacctgaagaactacattgataaacaactcctgcctatcctgaataagcagtcctgtagcatttctaacatcgagaccgtgattgagttccagcagaaaaataaccggctcctggaaatcacgcgcgagttttccgtgaatgccggcgtcacaaccccggttagcacatatatgcttaccaactccgaactgctctctctgatcaatgacatgcccattaccaacgatcaaaagaaacttatgagcaacaatgtgcagatcgtgagacagcagtcctacagcattatgtgcatcattaaggaggaagtcctggcttatgtggttcaactccctctgtacggggtgatcgacacaccctgttggaaactgcatacgtctcctctctgcaccacaaacaccaaggagggatccaatatctgtctgacacggaccgatcgcggctggtactgcgacaacgccgggagcgtctctttctttccccaggcggaaacgtgtaaggtgcagagcaatagagttttctgcgatacaatgaactccagaaccctgccttctgaggtgaatctctgcaacgtcgacatttttaatccgaaatatgattgtaagatcatgaccagcaaaacagacgtgtccagctctgtcattacctccctgggagccatcgtgagctgctacggcaagacaaaatgtacggcttctaacaagtgccgggggattatcaagaccttctccaatggatgtgattatgttagcaacaaaggcgtggacacagtctccgtgggcaataccctttactatgttaacaagcaagaggggaaatctctgtacgtgaagggagaacccatcattaatttttatgaccctctcgtcttccccagcgatgagtttgacgcctccatctctcaggtgaacgagaaaattaaccagagcctggctttcatccgcaagtccgatgaactgctccacaatgtgaacgccggcaagagcacaaccaatattatgatcacgaccattatcatcgttattatcgtcattctgctttctctgatcgccgtggggctcctgctgtactgcaaagctagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5942 - RNA, 2120 nt, synthetic construct
  misc_feature 1..2120: note = mRNA product Design f-4 comprising derived and/or modified sequence from HRSV(A2)__F-del_DSCav1_mut5 (opt6)
  source 1..2120: mol_type = other RNA
gggagagtcccgcagtcggcgtccagcggctctgcttgttcgtgtgtgtgtcgttgcaggccttattcaagcttaccatggaacttttaatactgaaagcaaatgccatcacaaccatactaactgccgtcacattctgctttgcatcaggacaaaacataacagaagaattttaccaatccacatgctcagcagtatcaaaaggatatctatcggcacttagaactggatggtacacaagtgttataactatagaactctcaaacataaaagaaaacaaatgcaatggaacagacgcaaaagtaaaactaataaaacaagaactcgataaatataaaaatgcagtaaccgaactacaactattaatgcaaagcacacccgcaacaggcagcggatcagcaatagcaagcggagtcgcagtatgtaaagtactacatctagaaggagaagtcaacaaaatcaaatctgcacttctatccacaaacaaagctgtagtatccctatccggatgcggagtctcagtattaacttttaaagtactagaccttaaaaactacatagataaacaactattaccaatactaaataaacaatcatgcagcatatccaatatagagacagtaattgaatttcaacaaaaaaacaacagattactagaaattactcgtgaattttccgtaaatgccggagtcacaacaccagtatcaacctatatgctaacaaacagcgaactacttagcttaataaatgacatgccaataacaaatgaccaaaaaaaacttatgtcaaataacgtacaaatcgtcagacaacaatcctactctataatgtgtataattaaagaagaagtcctagcatacgtagttcaattaccactctatggagtaatagatacaccatgctggaaactacacacgtcaccactatgtacaacaaacacaaaagaaggatccaatatatgcctaacaagaaccgacagaggctggtattgtgacaacgcaggatccgtttcattcttcccacaagcagaaacctgtaaagtacaatctaatagagtattttgcgacacaatgaacagtagaacactaccaagcgaggttaatctatgtaacgtagacatattcaatccaaaatatgattgcaaaataatgacatcaaaaacagatgtatcgtcgagtgtaataacaagtctgggagctatagtaagctgctacggcaagacgaaatgtaccgcttcaaataaatgcagaggaatcattaaaacattctcgaacggatgcgactacgtaagtaataaaggtgtcgacaccgtatcagtagggaatacattatactacgtcaacaaacaagaaggaaaatctctatatgtaaaaggagaaccaataataaatttctatgaccctctagtattcccatcagatgaatttgacgcttccatatcacaagtaaacgaaaaaatcaatcaatctttagcattcatacgaaaaagtgatgaactcctacacaacgtcaacgcaggaaaaagcacaacaaatataatgatcacaacaatcatcatagtaataatagtaatactactatcattaatagcagtaggattattgctttactgcaaagcacgatagggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5943 - RNA, 2120 nt, synthetic construct
  misc_feature 1..2120: note = mRNA product Design f-4 comprising derived and/or modified sequence from HRSV(A2)__F-del_DSCav1_mut5 (opt11)
  source 1..2120: mol_type = other RNA
gggagagtcccgcagtcggcgtccagcggctctgcttgttcgtgtgtgtgtcgttgcaggccttattcaagcttaccatggaactcctcatcctcaaagccaacgccataaccacaatactcaccgccgtaaccttctgctttgcgtcgggacaaaacatcaccgaagagttctaccaatccacttgctccgcagtaagcaaaggatacctctccgccctgcgaaccggttggtacacatcagtcatcacaatcgaactctcaaacataaaagaaaacaaatgcaacggcaccgacgcaaaggtcaaattaatcaagcaagaactagacaaatacaaaaacgccgtcacagaactccagctgctaatgcagagcacacccgcaactggcagcggatccgccatcgcatcaggagtcgccgtgtgcaaagtcctacacctcgaaggagaagtgaacaaaatcaaatcagccctactctccaccaacaaggccgtcgtctccctctccggctgcggtgtctccgtcctaaccttcaaagtgctagacctcaagaactacatcgacaaacaactcctaccaatactcaacaagcaatcttgctccatctccaacatcgaaaccgtaatcgagttccaacagaagaacaaccgcctcctcgaaatcacccgcgagttctctgtcaacgcaggggtcaccactcccgtctccacatacatgctcacaaactccgaactcctcagcctcatcaacgacatgcccataaccaacgaccagaaaaagctaatgagcaataacgtccaaatcgttagacaacaaagttattccatcatgtgcatcatcaaagaagaagtcctcgcctacgtcgtacaactccccctctatggcgtcatcgacaccccctgctggaaactgcacacatcacccctctgcaccacaaacaccaaagaaggctcaaacatctgcctaactcgcaccgaccgcggctggtactgcgacaacgccggcagcgtatcattctttccccaagccgaaacatgcaaagttcaatccaaccgcgtcttctgcgacacaatgaactccagaacgctccccagcgaagtcaacctctgtaacgtagacatcttcaaccctaagtacgactgcaaaatcatgacctccaaaactgatgtatcctcctccgtcatcacatccctgggcgccatcgtcagctgctacggcaaaacaaaatgcactgcctcaaacaaatgccgaggtatcataaagaccttctcaaacggatgcgattacgtcagcaacaaaggcgtcgacaccgtcagtgtcggcaacaccctctactacgtcaacaaacaagaaggaaaatccctctacgtcaaaggcgaacccatcatcaacttctacgaccccctcgtcttccccagcgacgagttcgacgcctccatctcacaagtcaacgaaaagataaaccaatctctagccttcatccgcaaatccgatgaactcctgcataacgtcaacgccggcaaatccaccacaaacatcatgatcactaccataatcatcgtcataatcgtaatcctcctatctcttatcgcagtcggcctactactctactgcaaagcccgctaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5944 - RNA, 1896 nt, synthetic construct
  misc_feature 1..1896: note = mRNA product Design f-5 comprising derived and/or modified sequence from HRSV(A2)__F-del_DSCav1_mut5 (opt1)
  source 1..1896: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5945 - RNA, 1896 nt, synthetic construct
  misc_feature 1..1896: note = mRNA product Design f-5 comprising derived and/or modified sequence from HRSV(A2)__F-del_DSCav1_mut5 (opt1)
  source 1..1896: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcgggtgcggcgtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggggtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggcgtgatcgacacgccgtgctggaagctgcacaccagccccctctgcaccaccaacacgaaggaggggtccaacatctgcctgacccgcaccgaccggggctggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggggccatcgtgtcctgctacggcaagaccaagtgcaccgccagcaacaagtgccgggggatcatcaagaccttctccaacggctgcgactacgtgagcaacaagggcgtcgacacggtgagcgtggggaacaccctctactacgtcaacaagcaggagggcaagtccctgtacgtgaagggggagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccggcaagtccaccaccaacatcatgatcaccacgatcatcatcgtgatcatcgtcatcctcctgagcctgatcgccgtggggctcctgctgtactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5946 - RNA, 1896 nt, synthetic construct
  misc_feature 1..1896: note = mRNA product Design f-5 comprising derived and/or modified sequence from HRSV(A2)__F-del_DSCav1_mut5 (opt2)
  source 1..1896: mol_type = other RNA
gggagactttcccattctgtagcagaatttggtgttgcctgtggtcttggtcccgcggagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5947 - RNA, 1896 nt, synthetic construct
  misc_feature 1..1896: note = mRNA product Design f-5 comprising derived and/or modified sequence from HRSV(A2)__F-del_DSCav1_mut5 (opt3)
  source 1..1896: mol_type = other RNA
gggagactttcccattctgtagcagaatttggtgttgcctgtggtcttggtcccgcggagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcggttgcggggtgtccgtattaacttttaaggttctggaccttaagaactacattgataaacaattgctgcctatcctaaataagcagtcatgtagtattagcaacatcgagaccgtgatagagttccagcagaaaaataacaggctcctggaaattacacgggagttttctgtcaatgcgggagtgactaccccagtgtccacatatatgcttaccaactcagaactgttgagcctcatcaatgacatgccgattacgaacgatcaaaagaaactgatgagtaacaatgtccagatcgttcgccagcagtcttactccatcatgtgcattataaaggaggaagtgttagcatatgtagtgcaactgcccctctacggcgtcatcgacactccttgttggaaacttcatacaagcccactgtgcaccactaacacaaaggagggctcgaatatttgtttgacccgaacggatcgtgggtggtactgcgacaacgccggatctgtgtccttctttccccaggctgaaacctgtaaggttcagtcaaatagagtgttctgcgatacaatgaacagtagaactctgcctagcgaggtcaatctctgcaacgtggacatctttaatccaaaatatgattgtaagataatgacctccaaaacagacgtatctagctcagttattaccagtctgggtgccatcgtgtcctgctacggcaagactaaatgtacagcaagcaacaagtgcagggggatcattaagaccttctctaatggatgtgattatgtctcaaacaaaggcgtggacactgtcagtgtgggtaatacgctttactatgttaacaagcaagaggggaaaagcctgtacgtgaagggagaacccatcattaatttttatgaccctttggtattcccatccgatgagtttgacgcttctatatcgcaggtcaacgagaaaatcaaccagagcctcgccttcattcggaagtccgatgaactgttacacaatgtgaacgcgggcaagtcaacaaccaatatcatgatcactaccattataatcgttattatcgtgattctgctaagtctcatcgccgtcggcctgcttttgtactgcaaagcacgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5948 - RNA, 1896 nt, synthetic construct
  misc_feature 1..1896: note = mRNA product Design f-5 comprising derived and/or modified sequence from HRSV(A2)__F-del_DSCav1_mut5 (opt4)
  source 1..1896: mol_type = other RNA
gggagactttcccattctgtagcagaatttggtgttgcctgtggtcttggtcccgcggagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5949 - RNA, 1896 nt, synthetic construct
  misc_feature 1..1896: note = mRNA product Design f-5 comprising derived and/or modified sequence from HRSV(A2)__F-del_DSCav1_mut5 (opt5)
  source 1..1896: mol_type = other RNA
gggagactttcccattctgtagcagaatttggtgttgcctgtggtcttggtcccgcggagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcggatgcggcgtttctgtgctgacatttaaggtccttgacctgaagaactacattgataaacaactcctgcctatcctgaataagcagtcctgtagcatttctaacatcgagaccgtgattgagttccagcagaaaaataaccggctcctggaaatcacgcgcgagttttccgtgaatgccggcgtcacaaccccggttagcacatatatgcttaccaactccgaactgctctctctgatcaatgacatgcccattaccaacgatcaaaagaaacttatgagcaacaatgtgcagatcgtgagacagcagtcctacagcattatgtgcatcattaaggaggaagtcctggcttatgtggttcaactccctctgtacggggtgatcgacacaccctgttggaaactgcatacgtctcctctctgcaccacaaacaccaaggagggatccaatatctgtctgacacggaccgatcgcggctggtactgcgacaacgccgggagcgtctctttctttccccaggcggaaacgtgtaaggtgcagagcaatagagttttctgcgatacaatgaactccagaaccctgccttctgaggtgaatctctgcaacgtcgacatttttaatccgaaatatgattgtaagatcatgaccagcaaaacagacgtgtccagctctgtcattacctccctgggagccatcgtgagctgctacggcaagacaaaatgtacggcttctaacaagtgccgggggattatcaagaccttctccaatggatgtgattatgttagcaacaaaggcgtggacacagtctccgtgggcaataccctttactatgttaacaagcaagaggggaaatctctgtacgtgaagggagaacccatcattaatttttatgaccctctcgtcttccccagcgatgagtttgacgcctccatctctcaggtgaacgagaaaattaaccagagcctggctttcatccgcaagtccgatgaactgctccacaatgtgaacgccggcaagagcacaaccaatattatgatcacgaccattatcatcgttattatcgtcattctgctttctctgatcgccgtggggctcctgctgtactgcaaagctagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5950 - RNA, 1896 nt, synthetic construct
  misc_feature 1..1896: note = mRNA product Design f-5 comprising derived and/or modified sequence from HRSV(A2)__F-del_DSCav1_mut5 (opt6)
  source 1..1896: mol_type = other RNA
gggagactttcccattctgtagcagaatttggtgttgcctgtggtcttggtcccgcggagaagcttaccatggaacttttaatactgaaagcaaatgccatcacaaccatactaactgccgtcacattctgctttgcatcaggacaaaacataacagaagaattttaccaatccacatgctcagcagtatcaaaaggatatctatcggcacttagaactggatggtacacaagtgttataactatagaactctcaaacataaaagaaaacaaatgcaatggaacagacgcaaaagtaaaactaataaaacaagaactcgataaatataaaaatgcagtaaccgaactacaactattaatgcaaagcacacccgcaacaggcagcggatcagcaatagcaagcggagtcgcagtatgtaaagtactacatctagaaggagaagtcaacaaaatcaaatctgcacttctatccacaaacaaagctgtagtatccctatccggatgcggagtctcagtattaacttttaaagtactagaccttaaaaactacatagataaacaactattaccaatactaaataaacaatcatgcagcatatccaatatagagacagtaattgaatttcaacaaaaaaacaacagattactagaaattactcgtgaattttccgtaaatgccggagtcacaacaccagtatcaacctatatgctaacaaacagcgaactacttagcttaataaatgacatgccaataacaaatgaccaaaaaaaacttatgtcaaataacgtacaaatcgtcagacaacaatcctactctataatgtgtataattaaagaagaagtcctagcatacgtagttcaattaccactctatggagtaatagatacaccatgctggaaactacacacgtcaccactatgtacaacaaacacaaaagaaggatccaatatatgcctaacaagaaccgacagaggctggtattgtgacaacgcaggatccgtttcattcttcccacaagcagaaacctgtaaagtacaatctaatagagtattttgcgacacaatgaacagtagaacactaccaagcgaggttaatctatgtaacgtagacatattcaatccaaaatatgattgcaaaataatgacatcaaaaacagatgtatcgtcgagtgtaataacaagtctgggagctatagtaagctgctacggcaagacgaaatgtaccgcttcaaataaatgcagaggaatcattaaaacattctcgaacggatgcgactacgtaagtaataaaggtgtcgacaccgtatcagtagggaatacattatactacgtcaacaaacaagaaggaaaatctctatatgtaaaaggagaaccaataataaatttctatgaccctctagtattcccatcagatgaatttgacgcttccatatcacaagtaaacgaaaaaatcaatcaatctttagcattcatacgaaaaagtgatgaactcctacacaacgtcaacgcaggaaaaagcacaacaaatataatgatcacaacaatcatcatagtaataatagtaatactactatcattaatagcagtaggattattgctttactgcaaagcacgatagggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5951 - RNA, 1896 nt, synthetic construct
  misc_feature 1..1896: note = mRNA product Design f-5 comprising derived and/or modified sequence from HRSV(A2)__F-del_DSCav1_mut5 (opt11)
  source 1..1896: mol_type = other RNA
gggagactttcccattctgtagcagaatttggtgttgcctgtggtcttggtcccgcggagaagcttaccatggaactcctcatcctcaaagccaacgccataaccacaatactcaccgccgtaaccttctgctttgcgtcgggacaaaacatcaccgaagagttctaccaatccacttgctccgcagtaagcaaaggatacctctccgccctgcgaaccggttggtacacatcagtcatcacaatcgaactctcaaacataaaagaaaacaaatgcaacggcaccgacgcaaaggtcaaattaatcaagcaagaactagacaaatacaaaaacgccgtcacagaactccagctgctaatgcagagcacacccgcaactggcagcggatccgccatcgcatcaggagtcgccgtgtgcaaagtcctacacctcgaaggagaagtgaacaaaatcaaatcagccctactctccaccaacaaggccgtcgtctccctctccggctgcggtgtctccgtcctaaccttcaaagtgctagacctcaagaactacatcgacaaacaactcctaccaatactcaacaagcaatcttgctccatctccaacatcgaaaccgtaatcgagttccaacagaagaacaaccgcctcctcgaaatcacccgcgagttctctgtcaacgcaggggtcaccactcccgtctccacatacatgctcacaaactccgaactcctcagcctcatcaacgacatgcccataaccaacgaccagaaaaagctaatgagcaataacgtccaaatcgttagacaacaaagttattccatcatgtgcatcatcaaagaagaagtcctcgcctacgtcgtacaactccccctctatggcgtcatcgacaccccctgctggaaactgcacacatcacccctctgcaccacaaacaccaaagaaggctcaaacatctgcctaactcgcaccgaccgcggctggtactgcgacaacgccggcagcgtatcattctttccccaagccgaaacatgcaaagttcaatccaaccgcgtcttctgcgacacaatgaactccagaacgctccccagcgaagtcaacctctgtaacgtagacatcttcaaccctaagtacgactgcaaaatcatgacctccaaaactgatgtatcctcctccgtcatcacatccctgggcgccatcgtcagctgctacggcaaaacaaaatgcactgcctcaaacaaatgccgaggtatcataaagaccttctcaaacggatgcgattacgtcagcaacaaaggcgtcgacaccgtcagtgtcggcaacaccctctactacgtcaacaaacaagaaggaaaatccctctacgtcaaaggcgaacccatcatcaacttctacgaccccctcgtcttccccagcgacgagttcgacgcctccatctcacaagtcaacgaaaagataaaccaatctctagccttcatccgcaaatccgatgaactcctgcataacgtcaacgccggcaaatccaccacaaacatcatgatcactaccataatcatcgtcataatcgtaatcctcctatctcttatcgcagtcggcctactactctactgcaaagcccgctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5952 - RNA, 1892 nt, synthetic construct
  misc_feature 1..1892: note = mRNA product Design g-1 comprising derived and/or modified sequence from HRSV(A2)__F-del_DSCav1_mut5 (opt1)
  source 1..1892: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5953 - RNA, 1892 nt, synthetic construct
  misc_feature 1..1892: note = mRNA product Design g-1 comprising derived and/or modified sequence from HRSV(A2)__F-del_DSCav1_mut5 (opt1)
  source 1..1892: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcgggtgcggcgtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggggtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggcgtgatcgacacgccgtgctggaagctgcacaccagccccctctgcaccaccaacacgaaggaggggtccaacatctgcctgacccgcaccgaccggggctggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggggccatcgtgtcctgctacggcaagaccaagtgcaccgccagcaacaagtgccgggggatcatcaagaccttctccaacggctgcgactacgtgagcaacaagggcgtcgacacggtgagcgtggggaacaccctctactacgtcaacaagcaggagggcaagtccctgtacgtgaagggggagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccggcaagtccaccaccaacatcatgatcaccacgatcatcatcgtgatcatcgtcatcctcctgagcctgatcgccgtggggctcctgctgtactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5954 - RNA, 1892 nt, synthetic construct
  misc_feature 1..1892: note = mRNA product Design g-1 comprising derived and/or modified sequence from HRSV(A2)__F-del_DSCav1_mut5 (opt2)
  source 1..1892: mol_type = other RNA
gggagactttcccattctgtagcagaatttggtgttgcctgtggtcttggtcccgcggagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5955 - RNA, 1892 nt, synthetic construct
  misc_feature 1..1892: note = mRNA product Design g-1 comprising derived and/or modified sequence from HRSV(A2)__F-del_DSCav1_mut5 (opt3)
  source 1..1892: mol_type = other RNA
gggagactttcccattctgtagcagaatttggtgttgcctgtggtcttggtcccgcggagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcggttgcggggtgtccgtattaacttttaaggttctggaccttaagaactacattgataaacaattgctgcctatcctaaataagcagtcatgtagtattagcaacatcgagaccgtgatagagttccagcagaaaaataacaggctcctggaaattacacgggagttttctgtcaatgcgggagtgactaccccagtgtccacatatatgcttaccaactcagaactgttgagcctcatcaatgacatgccgattacgaacgatcaaaagaaactgatgagtaacaatgtccagatcgttcgccagcagtcttactccatcatgtgcattataaaggaggaagtgttagcatatgtagtgcaactgcccctctacggcgtcatcgacactccttgttggaaacttcatacaagcccactgtgcaccactaacacaaaggagggctcgaatatttgtttgacccgaacggatcgtgggtggtactgcgacaacgccggatctgtgtccttctttccccaggctgaaacctgtaaggttcagtcaaatagagtgttctgcgatacaatgaacagtagaactctgcctagcgaggtcaatctctgcaacgtggacatctttaatccaaaatatgattgtaagataatgacctccaaaacagacgtatctagctcagttattaccagtctgggtgccatcgtgtcctgctacggcaagactaaatgtacagcaagcaacaagtgcagggggatcattaagaccttctctaatggatgtgattatgtctcaaacaaaggcgtggacactgtcagtgtgggtaatacgctttactatgttaacaagcaagaggggaaaagcctgtacgtgaagggagaacccatcattaatttttatgaccctttggtattcccatccgatgagtttgacgcttctatatcgcaggtcaacgagaaaatcaaccagagcctcgccttcattcggaagtccgatgaactgttacacaatgtgaacgcgggcaagtcaacaaccaatatcatgatcactaccattataatcgttattatcgtgattctgctaagtctcatcgccgtcggcctgcttttgtactgcaaagcacgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5956 - RNA, 1892 nt, synthetic construct
  misc_feature 1..1892: note = mRNA product Design g-1 comprising derived and/or modified sequence from HRSV(A2)__F-del_DSCav1_mut5 (opt4)
  source 1..1892: mol_type = other RNA
gggagactttcccattctgtagcagaatttggtgttgcctgtggtcttggtcccgcggagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5957 - RNA, 1892 nt, synthetic construct
  misc_feature 1..1892: note = mRNA product Design g-1 comprising derived and/or modified sequence from HRSV(A2)__F-del_DSCav1_mut5 (opt5)
  source 1..1892: mol_type = other RNA
gggagactttcccattctgtagcagaatttggtgttgcctgtggtcttggtcccgcggagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcggatgcggcgtttctgtgctgacatttaaggtccttgacctgaagaactacattgataaacaactcctgcctatcctgaataagcagtcctgtagcatttctaacatcgagaccgtgattgagttccagcagaaaaataaccggctcctggaaatcacgcgcgagttttccgtgaatgccggcgtcacaaccccggttagcacatatatgcttaccaactccgaactgctctctctgatcaatgacatgcccattaccaacgatcaaaagaaacttatgagcaacaatgtgcagatcgtgagacagcagtcctacagcattatgtgcatcattaaggaggaagtcctggcttatgtggttcaactccctctgtacggggtgatcgacacaccctgttggaaactgcatacgtctcctctctgcaccacaaacaccaaggagggatccaatatctgtctgacacggaccgatcgcggctggtactgcgacaacgccgggagcgtctctttctttccccaggcggaaacgtgtaaggtgcagagcaatagagttttctgcgatacaatgaactccagaaccctgccttctgaggtgaatctctgcaacgtcgacatttttaatccgaaatatgattgtaagatcatgaccagcaaaacagacgtgtccagctctgtcattacctccctgggagccatcgtgagctgctacggcaagacaaaatgtacggcttctaacaagtgccgggggattatcaagaccttctccaatggatgtgattatgttagcaacaaaggcgtggacacagtctccgtgggcaataccctttactatgttaacaagcaagaggggaaatctctgtacgtgaagggagaacccatcattaatttttatgaccctctcgtcttccccagcgatgagtttgacgcctccatctctcaggtgaacgagaaaattaaccagagcctggctttcatccgcaagtccgatgaactgctccacaatgtgaacgccggcaagagcacaaccaatattatgatcacgaccattatcatcgttattatcgtcattctgctttctctgatcgccgtggggctcctgctgtactgcaaagctagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5958 - RNA, 1892 nt, synthetic construct
  misc_feature 1..1892: note = mRNA product Design g-1 comprising derived and/or modified sequence from HRSV(A2)__F-del_DSCav1_mut5 (opt6)
  source 1..1892: mol_type = other RNA
gggagactttcccattctgtagcagaatttggtgttgcctgtggtcttggtcccgcggagaagcttaccatggaacttttaatactgaaagcaaatgccatcacaaccatactaactgccgtcacattctgctttgcatcaggacaaaacataacagaagaattttaccaatccacatgctcagcagtatcaaaaggatatctatcggcacttagaactggatggtacacaagtgttataactatagaactctcaaacataaaagaaaacaaatgcaatggaacagacgcaaaagtaaaactaataaaacaagaactcgataaatataaaaatgcagtaaccgaactacaactattaatgcaaagcacacccgcaacaggcagcggatcagcaatagcaagcggagtcgcagtatgtaaagtactacatctagaaggagaagtcaacaaaatcaaatctgcacttctatccacaaacaaagctgtagtatccctatccggatgcggagtctcagtattaacttttaaagtactagaccttaaaaactacatagataaacaactattaccaatactaaataaacaatcatgcagcatatccaatatagagacagtaattgaatttcaacaaaaaaacaacagattactagaaattactcgtgaattttccgtaaatgccggagtcacaacaccagtatcaacctatatgctaacaaacagcgaactacttagcttaataaatgacatgccaataacaaatgaccaaaaaaaacttatgtcaaataacgtacaaatcgtcagacaacaatcctactctataatgtgtataattaaagaagaagtcctagcatacgtagttcaattaccactctatggagtaatagatacaccatgctggaaactacacacgtcaccactatgtacaacaaacacaaaagaaggatccaatatatgcctaacaagaaccgacagaggctggtattgtgacaacgcaggatccgtttcattcttcccacaagcagaaacctgtaaagtacaatctaatagagtattttgcgacacaatgaacagtagaacactaccaagcgaggttaatctatgtaacgtagacatattcaatccaaaatatgattgcaaaataatgacatcaaaaacagatgtatcgtcgagtgtaataacaagtctgggagctatagtaagctgctacggcaagacgaaatgtaccgcttcaaataaatgcagaggaatcattaaaacattctcgaacggatgcgactacgtaagtaataaaggtgtcgacaccgtatcagtagggaatacattatactacgtcaacaaacaagaaggaaaatctctatatgtaaaaggagaaccaataataaatttctatgaccctctagtattcccatcagatgaatttgacgcttccatatcacaagtaaacgaaaaaatcaatcaatctttagcattcatacgaaaaagtgatgaactcctacacaacgtcaacgcaggaaaaagcacaacaaatataatgatcacaacaatcatcatagtaataatagtaatactactatcattaatagcagtaggattattgctttactgcaaagcacgatagggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5959 - RNA, 1892 nt, synthetic construct
  misc_feature 1..1892: note = mRNA product Design g-1 comprising derived and/or modified sequence from HRSV(A2)__F-del_DSCav1_mut5 (opt11)
  source 1..1892: mol_type = other RNA
gggagactttcccattctgtagcagaatttggtgttgcctgtggtcttggtcccgcggagaagcttaccatggaactcctcatcctcaaagccaacgccataaccacaatactcaccgccgtaaccttctgctttgcgtcgggacaaaacatcaccgaagagttctaccaatccacttgctccgcagtaagcaaaggatacctctccgccctgcgaaccggttggtacacatcagtcatcacaatcgaactctcaaacataaaagaaaacaaatgcaacggcaccgacgcaaaggtcaaattaatcaagcaagaactagacaaatacaaaaacgccgtcacagaactccagctgctaatgcagagcacacccgcaactggcagcggatccgccatcgcatcaggagtcgccgtgtgcaaagtcctacacctcgaaggagaagtgaacaaaatcaaatcagccctactctccaccaacaaggccgtcgtctccctctccggctgcggtgtctccgtcctaaccttcaaagtgctagacctcaagaactacatcgacaaacaactcctaccaatactcaacaagcaatcttgctccatctccaacatcgaaaccgtaatcgagttccaacagaagaacaaccgcctcctcgaaatcacccgcgagttctctgtcaacgcaggggtcaccactcccgtctccacatacatgctcacaaactccgaactcctcagcctcatcaacgacatgcccataaccaacgaccagaaaaagctaatgagcaataacgtccaaatcgttagacaacaaagttattccatcatgtgcatcatcaaagaagaagtcctcgcctacgtcgtacaactccccctctatggcgtcatcgacaccccctgctggaaactgcacacatcacccctctgcaccacaaacaccaaagaaggctcaaacatctgcctaactcgcaccgaccgcggctggtactgcgacaacgccggcagcgtatcattctttccccaagccgaaacatgcaaagttcaatccaaccgcgtcttctgcgacacaatgaactccagaacgctccccagcgaagtcaacctctgtaacgtagacatcttcaaccctaagtacgactgcaaaatcatgacctccaaaactgatgtatcctcctccgtcatcacatccctgggcgccatcgtcagctgctacggcaaaacaaaatgcactgcctcaaacaaatgccgaggtatcataaagaccttctcaaacggatgcgattacgtcagcaacaaaggcgtcgacaccgtcagtgtcggcaacaccctctactacgtcaacaaacaagaaggaaaatccctctacgtcaaaggcgaacccatcatcaacttctacgaccccctcgtcttccccagcgacgagttcgacgcctccatctcacaagtcaacgaaaagataaaccaatctctagccttcatccgcaaatccgatgaactcctgcataacgtcaacgccggcaaatccaccacaaacatcatgatcactaccataatcatcgtcataatcgtaatcctcctatctcttatcgcagtcggcctactactctactgcaaagcccgctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5960 - RNA, 1907 nt, synthetic construct
  misc_feature 1..1907: note = mRNA product Design g-2 comprising derived and/or modified sequence from HRSV(A2)__F-del_DSCav1_mut5 (opt1)
  source 1..1907: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5961 - RNA, 1907 nt, synthetic construct
  misc_feature 1..1907: note = mRNA product Design g-2 comprising derived and/or modified sequence from HRSV(A2)__F-del_DSCav1_mut5 (opt1)
  source 1..1907: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcgggtgcggcgtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggggtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggcgtgatcgacacgccgtgctggaagctgcacaccagccccctctgcaccaccaacacgaaggaggggtccaacatctgcctgacccgcaccgaccggggctggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggggccatcgtgtcctgctacggcaagaccaagtgcaccgccagcaacaagtgccgggggatcatcaagaccttctccaacggctgcgactacgtgagcaacaagggcgtcgacacggtgagcgtggggaacaccctctactacgtcaacaagcaggagggcaagtccctgtacgtgaagggggagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccggcaagtccaccaccaacatcatgatcaccacgatcatcatcgtgatcatcgtcatcctcctgagcctgatcgccgtggggctcctgctgtactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5962 - RNA, 1907 nt, synthetic construct
  misc_feature 1..1907: note = mRNA product Design g-2 comprising derived and/or modified sequence from HRSV(A2)__F-del_DSCav1_mut5 (opt2)
  source 1..1907: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5963 - RNA, 1907 nt, synthetic construct
  misc_feature 1..1907: note = mRNA product Design g-2 comprising derived and/or modified sequence from HRSV(A2)__F-del_DSCav1_mut5 (opt3)
  source 1..1907: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcggttgcggggtgtccgtattaacttttaaggttctggaccttaagaactacattgataaacaattgctgcctatcctaaataagcagtcatgtagtattagcaacatcgagaccgtgatagagttccagcagaaaaataacaggctcctggaaattacacgggagttttctgtcaatgcgggagtgactaccccagtgtccacatatatgcttaccaactcagaactgttgagcctcatcaatgacatgccgattacgaacgatcaaaagaaactgatgagtaacaatgtccagatcgttcgccagcagtcttactccatcatgtgcattataaaggaggaagtgttagcatatgtagtgcaactgcccctctacggcgtcatcgacactccttgttggaaacttcatacaagcccactgtgcaccactaacacaaaggagggctcgaatatttgtttgacccgaacggatcgtgggtggtactgcgacaacgccggatctgtgtccttctttccccaggctgaaacctgtaaggttcagtcaaatagagtgttctgcgatacaatgaacagtagaactctgcctagcgaggtcaatctctgcaacgtggacatctttaatccaaaatatgattgtaagataatgacctccaaaacagacgtatctagctcagttattaccagtctgggtgccatcgtgtcctgctacggcaagactaaatgtacagcaagcaacaagtgcagggggatcattaagaccttctctaatggatgtgattatgtctcaaacaaaggcgtggacactgtcagtgtgggtaatacgctttactatgttaacaagcaagaggggaaaagcctgtacgtgaagggagaacccatcattaatttttatgaccctttggtattcccatccgatgagtttgacgcttctatatcgcaggtcaacgagaaaatcaaccagagcctcgccttcattcggaagtccgatgaactgttacacaatgtgaacgcgggcaagtcaacaaccaatatcatgatcactaccattataatcgttattatcgtgattctgctaagtctcatcgccgtcggcctgcttttgtactgcaaagcacgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5964 - RNA, 1907 nt, synthetic construct
  misc_feature 1..1907: note = mRNA product Design g-2 comprising derived and/or modified sequence from HRSV(A2)__F-del_DSCav1_mut5 (opt4)
  source 1..1907: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5965 - RNA, 1907 nt, synthetic construct
  misc_feature 1..1907: note = mRNA product Design g-2 comprising derived and/or modified sequence from HRSV(A2)__F-del_DSCav1_mut5 (opt5)
  source 1..1907: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcggatgcggcgtttctgtgctgacatttaaggtccttgacctgaagaactacattgataaacaactcctgcctatcctgaataagcagtcctgtagcatttctaacatcgagaccgtgattgagttccagcagaaaaataaccggctcctggaaatcacgcgcgagttttccgtgaatgccggcgtcacaaccccggttagcacatatatgcttaccaactccgaactgctctctctgatcaatgacatgcccattaccaacgatcaaaagaaacttatgagcaacaatgtgcagatcgtgagacagcagtcctacagcattatgtgcatcattaaggaggaagtcctggcttatgtggttcaactccctctgtacggggtgatcgacacaccctgttggaaactgcatacgtctcctctctgcaccacaaacaccaaggagggatccaatatctgtctgacacggaccgatcgcggctggtactgcgacaacgccgggagcgtctctttctttccccaggcggaaacgtgtaaggtgcagagcaatagagttttctgcgatacaatgaactccagaaccctgccttctgaggtgaatctctgcaacgtcgacatttttaatccgaaatatgattgtaagatcatgaccagcaaaacagacgtgtccagctctgtcattacctccctgggagccatcgtgagctgctacggcaagacaaaatgtacggcttctaacaagtgccgggggattatcaagaccttctccaatggatgtgattatgttagcaacaaaggcgtggacacagtctccgtgggcaataccctttactatgttaacaagcaagaggggaaatctctgtacgtgaagggagaacccatcattaatttttatgaccctctcgtcttccccagcgatgagtttgacgcctccatctctcaggtgaacgagaaaattaaccagagcctggctttcatccgcaagtccgatgaactgctccacaatgtgaacgccggcaagagcacaaccaatattatgatcacgaccattatcatcgttattatcgtcattctgctttctctgatcgccgtggggctcctgctgtactgcaaagctagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5966 - RNA, 1907 nt, synthetic construct
  misc_feature 1..1907: note = mRNA product Design g-2 comprising derived and/or modified sequence from HRSV(A2)__F-del_DSCav1_mut5 (opt6)
  source 1..1907: mol_type = other RNA
gggagagtccgctcagccaggttgcagaagcggcttagcgtgtgtcctaatcttctctctgcgtgtaggtaggcctgtgccgcaaacaagcttaccatggaacttttaatactgaaagcaaatgccatcacaaccatactaactgccgtcacattctgctttgcatcaggacaaaacataacagaagaattttaccaatccacatgctcagcagtatcaaaaggatatctatcggcacttagaactggatggtacacaagtgttataactatagaactctcaaacataaaagaaaacaaatgcaatggaacagacgcaaaagtaaaactaataaaacaagaactcgataaatataaaaatgcagtaaccgaactacaactattaatgcaaagcacacccgcaacaggcagcggatcagcaatagcaagcggagtcgcagtatgtaaagtactacatctagaaggagaagtcaacaaaatcaaatctgcacttctatccacaaacaaagctgtagtatccctatccggatgcggagtctcagtattaacttttaaagtactagaccttaaaaactacatagataaacaactattaccaatactaaataaacaatcatgcagcatatccaatatagagacagtaattgaatttcaacaaaaaaacaacagattactagaaattactcgtgaattttccgtaaatgccggagtcacaacaccagtatcaacctatatgctaacaaacagcgaactacttagcttaataaatgacatgccaataacaaatgaccaaaaaaaacttatgtcaaataacgtacaaatcgtcagacaacaatcctactctataatgtgtataattaaagaagaagtcctagcatacgtagttcaattaccactctatggagtaatagatacaccatgctggaaactacacacgtcaccactatgtacaacaaacacaaaagaaggatccaatatatgcctaacaagaaccgacagaggctggtattgtgacaacgcaggatccgtttcattcttcccacaagcagaaacctgtaaagtacaatctaatagagtattttgcgacacaatgaacagtagaacactaccaagcgaggttaatctatgtaacgtagacatattcaatccaaaatatgattgcaaaataatgacatcaaaaacagatgtatcgtcgagtgtaataacaagtctgggagctatagtaagctgctacggcaagacgaaatgtaccgcttcaaataaatgcagaggaatcattaaaacattctcgaacggatgcgactacgtaagtaataaaggtgtcgacaccgtatcagtagggaatacattatactacgtcaacaaacaagaaggaaaatctctatatgtaaaaggagaaccaataataaatttctatgaccctctagtattcccatcagatgaatttgacgcttccatatcacaagtaaacgaaaaaatcaatcaatctttagcattcatacgaaaaagtgatgaactcctacacaacgtcaacgcaggaaaaagcacaacaaatataatgatcacaacaatcatcatagtaataatagtaatactactatcattaatagcagtaggattattgctttactgcaaagcacgatagggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5967 - RNA, 1907 nt, synthetic construct
  misc_feature 1..1907: note = mRNA product Design g-2 comprising derived and/or modified sequence from HRSV(A2)__F-del_DSCav1_mut5 (opt11)
  source 1..1907: mol_type = other RNA
gggagagtccgctcagccaggttgcagaagcggcttagcgtgtgtcctaatcttctctctgcgtgtaggtaggcctgtgccgcaaacaagcttaccatggaactcctcatcctcaaagccaacgccataaccacaatactcaccgccgtaaccttctgctttgcgtcgggacaaaacatcaccgaagagttctaccaatccacttgctccgcagtaagcaaaggatacctctccgccctgcgaaccggttggtacacatcagtcatcacaatcgaactctcaaacataaaagaaaacaaatgcaacggcaccgacgcaaaggtcaaattaatcaagcaagaactagacaaatacaaaaacgccgtcacagaactccagctgctaatgcagagcacacccgcaactggcagcggatccgccatcgcatcaggagtcgccgtgtgcaaagtcctacacctcgaaggagaagtgaacaaaatcaaatcagccctactctccaccaacaaggccgtcgtctccctctccggctgcggtgtctccgtcctaaccttcaaagtgctagacctcaagaactacatcgacaaacaactcctaccaatactcaacaagcaatcttgctccatctccaacatcgaaaccgtaatcgagttccaacagaagaacaaccgcctcctcgaaatcacccgcgagttctctgtcaacgcaggggtcaccactcccgtctccacatacatgctcacaaactccgaactcctcagcctcatcaacgacatgcccataaccaacgaccagaaaaagctaatgagcaataacgtccaaatcgttagacaacaaagttattccatcatgtgcatcatcaaagaagaagtcctcgcctacgtcgtacaactccccctctatggcgtcatcgacaccccctgctggaaactgcacacatcacccctctgcaccacaaacaccaaagaaggctcaaacatctgcctaactcgcaccgaccgcggctggtactgcgacaacgccggcagcgtatcattctttccccaagccgaaacatgcaaagttcaatccaaccgcgtcttctgcgacacaatgaactccagaacgctccccagcgaagtcaacctctgtaacgtagacatcttcaaccctaagtacgactgcaaaatcatgacctccaaaactgatgtatcctcctccgtcatcacatccctgggcgccatcgtcagctgctacggcaaaacaaaatgcactgcctcaaacaaatgccgaggtatcataaagaccttctcaaacggatgcgattacgtcagcaacaaaggcgtcgacaccgtcagtgtcggcaacaccctctactacgtcaacaaacaagaaggaaaatccctctacgtcaaaggcgaacccatcatcaacttctacgaccccctcgtcttccccagcgacgagttcgacgcctccatctcacaagtcaacgaaaagataaaccaatctctagccttcatccgcaaatccgatgaactcctgcataacgtcaacgccggcaaatccaccacaaacatcatgatcactaccataatcatcgtcataatcgtaatcctcctatctcttatcgcagtcggcctactactctactgcaaagcccgctaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5968 - RNA, 2139 nt, synthetic construct
  misc_feature 1..2139: note = mRNA product Design g-3 comprising derived and/or modified sequence from HRSV(A2)__F-del_DSCav1_mut5 (opt1)
  source 1..2139: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5969 - RNA, 2139 nt, synthetic construct
  misc_feature 1..2139: note = mRNA product Design g-3 comprising derived and/or modified sequence from HRSV(A2)__F-del_DSCav1_mut5 (opt1)
  source 1..2139: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcgggtgcggcgtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggggtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggcgtgatcgacacgccgtgctggaagctgcacaccagccccctctgcaccaccaacacgaaggaggggtccaacatctgcctgacccgcaccgaccggggctggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggggccatcgtgtcctgctacggcaagaccaagtgcaccgccagcaacaagtgccgggggatcatcaagaccttctccaacggctgcgactacgtgagcaacaagggcgtcgacacggtgagcgtggggaacaccctctactacgtcaacaagcaggagggcaagtccctgtacgtgaagggggagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccggcaagtccaccaccaacatcatgatcaccacgatcatcatcgtgatcatcgtcatcctcctgagcctgatcgccgtggggctcctgctgtactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5970 - RNA, 2139 nt, synthetic construct
  misc_feature 1..2139: note = mRNA product Design g-3 comprising derived and/or modified sequence from HRSV(A2)__F-del_DSCav1_mut5 (opt2)
  source 1..2139: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5971 - RNA, 2139 nt, synthetic construct
  misc_feature 1..2139: note = mRNA product Design g-3 comprising derived and/or modified sequence from HRSV(A2)__F-del_DSCav1_mut5 (opt3)
  source 1..2139: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcggttgcggggtgtccgtattaacttttaaggttctggaccttaagaactacattgataaacaattgctgcctatcctaaataagcagtcatgtagtattagcaacatcgagaccgtgatagagttccagcagaaaaataacaggctcctggaaattacacgggagttttctgtcaatgcgggagtgactaccccagtgtccacatatatgcttaccaactcagaactgttgagcctcatcaatgacatgccgattacgaacgatcaaaagaaactgatgagtaacaatgtccagatcgttcgccagcagtcttactccatcatgtgcattataaaggaggaagtgttagcatatgtagtgcaactgcccctctacggcgtcatcgacactccttgttggaaacttcatacaagcccactgtgcaccactaacacaaaggagggctcgaatatttgtttgacccgaacggatcgtgggtggtactgcgacaacgccggatctgtgtccttctttccccaggctgaaacctgtaaggttcagtcaaatagagtgttctgcgatacaatgaacagtagaactctgcctagcgaggtcaatctctgcaacgtggacatctttaatccaaaatatgattgtaagataatgacctccaaaacagacgtatctagctcagttattaccagtctgggtgccatcgtgtcctgctacggcaagactaaatgtacagcaagcaacaagtgcagggggatcattaagaccttctctaatggatgtgattatgtctcaaacaaaggcgtggacactgtcagtgtgggtaatacgctttactatgttaacaagcaagaggggaaaagcctgtacgtgaagggagaacccatcattaatttttatgaccctttggtattcccatccgatgagtttgacgcttctatatcgcaggtcaacgagaaaatcaaccagagcctcgccttcattcggaagtccgatgaactgttacacaatgtgaacgcgggcaagtcaacaaccaatatcatgatcactaccattataatcgttattatcgtgattctgctaagtctcatcgccgtcggcctgcttttgtactgcaaagcacgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5972 - RNA, 2139 nt, synthetic construct
  misc_feature 1..2139: note = mRNA product Design g-3 comprising derived and/or modified sequence from HRSV(A2)__F-del_DSCav1_mut5 (opt4)
  source 1..2139: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5973 - RNA, 2139 nt, synthetic construct
  misc_feature 1..2139: note = mRNA product Design g-3 comprising derived and/or modified sequence from HRSV(A2)__F-del_DSCav1_mut5 (opt5)
  source 1..2139: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcggatgcggcgtttctgtgctgacatttaaggtccttgacctgaagaactacattgataaacaactcctgcctatcctgaataagcagtcctgtagcatttctaacatcgagaccgtgattgagttccagcagaaaaataaccggctcctggaaatcacgcgcgagttttccgtgaatgccggcgtcacaaccccggttagcacatatatgcttaccaactccgaactgctctctctgatcaatgacatgcccattaccaacgatcaaaagaaacttatgagcaacaatgtgcagatcgtgagacagcagtcctacagcattatgtgcatcattaaggaggaagtcctggcttatgtggttcaactccctctgtacggggtgatcgacacaccctgttggaaactgcatacgtctcctctctgcaccacaaacaccaaggagggatccaatatctgtctgacacggaccgatcgcggctggtactgcgacaacgccgggagcgtctctttctttccccaggcggaaacgtgtaaggtgcagagcaatagagttttctgcgatacaatgaactccagaaccctgccttctgaggtgaatctctgcaacgtcgacatttttaatccgaaatatgattgtaagatcatgaccagcaaaacagacgtgtccagctctgtcattacctccctgggagccatcgtgagctgctacggcaagacaaaatgtacggcttctaacaagtgccgggggattatcaagaccttctccaatggatgtgattatgttagcaacaaaggcgtggacacagtctccgtgggcaataccctttactatgttaacaagcaagaggggaaatctctgtacgtgaagggagaacccatcattaatttttatgaccctctcgtcttccccagcgatgagtttgacgcctccatctctcaggtgaacgagaaaattaaccagagcctggctttcatccgcaagtccgatgaactgctccacaatgtgaacgccggcaagagcacaaccaatattatgatcacgaccattatcatcgttattatcgtcattctgctttctctgatcgccgtggggctcctgctgtactgcaaagctagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5974 - RNA, 2139 nt, synthetic construct
  misc_feature 1..2139: note = mRNA product Design g-3 comprising derived and/or modified sequence from HRSV(A2)__F-del_DSCav1_mut5 (opt6)
  source 1..2139: mol_type = other RNA
gggagagtccgctcagccaggttgcagaagcggcttagcgtgtgtcctaatcttctctctgcgtgtaggtaggcctgtgccgcaaacaagcttaccatggaacttttaatactgaaagcaaatgccatcacaaccatactaactgccgtcacattctgctttgcatcaggacaaaacataacagaagaattttaccaatccacatgctcagcagtatcaaaaggatatctatcggcacttagaactggatggtacacaagtgttataactatagaactctcaaacataaaagaaaacaaatgcaatggaacagacgcaaaagtaaaactaataaaacaagaactcgataaatataaaaatgcagtaaccgaactacaactattaatgcaaagcacacccgcaacaggcagcggatcagcaatagcaagcggagtcgcagtatgtaaagtactacatctagaaggagaagtcaacaaaatcaaatctgcacttctatccacaaacaaagctgtagtatccctatccggatgcggagtctcagtattaacttttaaagtactagaccttaaaaactacatagataaacaactattaccaatactaaataaacaatcatgcagcatatccaatatagagacagtaattgaatttcaacaaaaaaacaacagattactagaaattactcgtgaattttccgtaaatgccggagtcacaacaccagtatcaacctatatgctaacaaacagcgaactacttagcttaataaatgacatgccaataacaaatgaccaaaaaaaacttatgtcaaataacgtacaaatcgtcagacaacaatcctactctataatgtgtataattaaagaagaagtcctagcatacgtagttcaattaccactctatggagtaatagatacaccatgctggaaactacacacgtcaccactatgtacaacaaacacaaaagaaggatccaatatatgcctaacaagaaccgacagaggctggtattgtgacaacgcaggatccgtttcattcttcccacaagcagaaacctgtaaagtacaatctaatagagtattttgcgacacaatgaacagtagaacactaccaagcgaggttaatctatgtaacgtagacatattcaatccaaaatatgattgcaaaataatgacatcaaaaacagatgtatcgtcgagtgtaataacaagtctgggagctatagtaagctgctacggcaagacgaaatgtaccgcttcaaataaatgcagaggaatcattaaaacattctcgaacggatgcgactacgtaagtaataaaggtgtcgacaccgtatcagtagggaatacattatactacgtcaacaaacaagaaggaaaatctctatatgtaaaaggagaaccaataataaatttctatgaccctctagtattcccatcagatgaatttgacgcttccatatcacaagtaaacgaaaaaatcaatcaatctttagcattcatacgaaaaagtgatgaactcctacacaacgtcaacgcaggaaaaagcacaacaaatataatgatcacaacaatcatcatagtaataatagtaatactactatcattaatagcagtaggattattgctttactgcaaagcacgatagggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5975 - RNA, 2139 nt, synthetic construct
  misc_feature 1..2139: note = mRNA product Design g-3 comprising derived and/or modified sequence from HRSV(A2)__F-del_DSCav1_mut5 (opt11)
  source 1..2139: mol_type = other RNA
gggagagtccgctcagccaggttgcagaagcggcttagcgtgtgtcctaatcttctctctgcgtgtaggtaggcctgtgccgcaaacaagcttaccatggaactcctcatcctcaaagccaacgccataaccacaatactcaccgccgtaaccttctgctttgcgtcgggacaaaacatcaccgaagagttctaccaatccacttgctccgcagtaagcaaaggatacctctccgccctgcgaaccggttggtacacatcagtcatcacaatcgaactctcaaacataaaagaaaacaaatgcaacggcaccgacgcaaaggtcaaattaatcaagcaagaactagacaaatacaaaaacgccgtcacagaactccagctgctaatgcagagcacacccgcaactggcagcggatccgccatcgcatcaggagtcgccgtgtgcaaagtcctacacctcgaaggagaagtgaacaaaatcaaatcagccctactctccaccaacaaggccgtcgtctccctctccggctgcggtgtctccgtcctaaccttcaaagtgctagacctcaagaactacatcgacaaacaactcctaccaatactcaacaagcaatcttgctccatctccaacatcgaaaccgtaatcgagttccaacagaagaacaaccgcctcctcgaaatcacccgcgagttctctgtcaacgcaggggtcaccactcccgtctccacatacatgctcacaaactccgaactcctcagcctcatcaacgacatgcccataaccaacgaccagaaaaagctaatgagcaataacgtccaaatcgttagacaacaaagttattccatcatgtgcatcatcaaagaagaagtcctcgcctacgtcgtacaactccccctctatggcgtcatcgacaccccctgctggaaactgcacacatcacccctctgcaccacaaacaccaaagaaggctcaaacatctgcctaactcgcaccgaccgcggctggtactgcgacaacgccggcagcgtatcattctttccccaagccgaaacatgcaaagttcaatccaaccgcgtcttctgcgacacaatgaactccagaacgctccccagcgaagtcaacctctgtaacgtagacatcttcaaccctaagtacgactgcaaaatcatgacctccaaaactgatgtatcctcctccgtcatcacatccctgggcgccatcgtcagctgctacggcaaaacaaaatgcactgcctcaaacaaatgccgaggtatcataaagaccttctcaaacggatgcgattacgtcagcaacaaaggcgtcgacaccgtcagtgtcggcaacaccctctactacgtcaacaaacaagaaggaaaatccctctacgtcaaaggcgaacccatcatcaacttctacgaccccctcgtcttccccagcgacgagttcgacgcctccatctcacaagtcaacgaaaagataaaccaatctctagccttcatccgcaaatccgatgaactcctgcataacgtcaacgccggcaaatccaccacaaacatcatgatcactaccataatcatcgtcataatcgtaatcctcctatctcttatcgcagtcggcctactactctactgcaaagcccgctaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5976 - RNA, 1934 nt, synthetic construct
  misc_feature 1..1934: note = mRNA product Design g-4 comprising derived and/or modified sequence from HRSV(A2)__F-del_DSCav1_mut5 (opt1)
  source 1..1934: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5977 - RNA, 1934 nt, synthetic construct
  misc_feature 1..1934: note = mRNA product Design g-4 comprising derived and/or modified sequence from HRSV(A2)__F-del_DSCav1_mut5 (opt1)
  source 1..1934: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcgggtgcggcgtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggggtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggcgtgatcgacacgccgtgctggaagctgcacaccagccccctctgcaccaccaacacgaaggaggggtccaacatctgcctgacccgcaccgaccggggctggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggggccatcgtgtcctgctacggcaagaccaagtgcaccgccagcaacaagtgccgggggatcatcaagaccttctccaacggctgcgactacgtgagcaacaagggcgtcgacacggtgagcgtggggaacaccctctactacgtcaacaagcaggagggcaagtccctgtacgtgaagggggagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccggcaagtccaccaccaacatcatgatcaccacgatcatcatcgtgatcatcgtcatcctcctgagcctgatcgccgtggggctcctgctgtactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5978 - RNA, 1934 nt, synthetic construct
  misc_feature 1..1934: note = mRNA product Design g-4 comprising derived and/or modified sequence from HRSV(A2)__F-del_DSCav1_mut5 (opt2)
  source 1..1934: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5979 - RNA, 1934 nt, synthetic construct
  misc_feature 1..1934: note = mRNA product Design g-4 comprising derived and/or modified sequence from HRSV(A2)__F-del_DSCav1_mut5 (opt3)
  source 1..1934: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcggttgcggggtgtccgtattaacttttaaggttctggaccttaagaactacattgataaacaattgctgcctatcctaaataagcagtcatgtagtattagcaacatcgagaccgtgatagagttccagcagaaaaataacaggctcctggaaattacacgggagttttctgtcaatgcgggagtgactaccccagtgtccacatatatgcttaccaactcagaactgttgagcctcatcaatgacatgccgattacgaacgatcaaaagaaactgatgagtaacaatgtccagatcgttcgccagcagtcttactccatcatgtgcattataaaggaggaagtgttagcatatgtagtgcaactgcccctctacggcgtcatcgacactccttgttggaaacttcatacaagcccactgtgcaccactaacacaaaggagggctcgaatatttgtttgacccgaacggatcgtgggtggtactgcgacaacgccggatctgtgtccttctttccccaggctgaaacctgtaaggttcagtcaaatagagtgttctgcgatacaatgaacagtagaactctgcctagcgaggtcaatctctgcaacgtggacatctttaatccaaaatatgattgtaagataatgacctccaaaacagacgtatctagctcagttattaccagtctgggtgccatcgtgtcctgctacggcaagactaaatgtacagcaagcaacaagtgcagggggatcattaagaccttctctaatggatgtgattatgtctcaaacaaaggcgtggacactgtcagtgtgggtaatacgctttactatgttaacaagcaagaggggaaaagcctgtacgtgaagggagaacccatcattaatttttatgaccctttggtattcccatccgatgagtttgacgcttctatatcgcaggtcaacgagaaaatcaaccagagcctcgccttcattcggaagtccgatgaactgttacacaatgtgaacgcgggcaagtcaacaaccaatatcatgatcactaccattataatcgttattatcgtgattctgctaagtctcatcgccgtcggcctgcttttgtactgcaaagcacgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5980 - RNA, 1934 nt, synthetic construct
  misc_feature 1..1934: note = mRNA product Design g-4 comprising derived and/or modified sequence from HRSV(A2)__F-del_DSCav1_mut5 (opt4)
  source 1..1934: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5981 - RNA, 1934 nt, synthetic construct
  misc_feature 1..1934: note = mRNA product Design g-4 comprising derived and/or modified sequence from HRSV(A2)__F-del_DSCav1_mut5 (opt5)
  source 1..1934: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcggatgcggcgtttctgtgctgacatttaaggtccttgacctgaagaactacattgataaacaactcctgcctatcctgaataagcagtcctgtagcatttctaacatcgagaccgtgattgagttccagcagaaaaataaccggctcctggaaatcacgcgcgagttttccgtgaatgccggcgtcacaaccccggttagcacatatatgcttaccaactccgaactgctctctctgatcaatgacatgcccattaccaacgatcaaaagaaacttatgagcaacaatgtgcagatcgtgagacagcagtcctacagcattatgtgcatcattaaggaggaagtcctggcttatgtggttcaactccctctgtacggggtgatcgacacaccctgttggaaactgcatacgtctcctctctgcaccacaaacaccaaggagggatccaatatctgtctgacacggaccgatcgcggctggtactgcgacaacgccgggagcgtctctttctttccccaggcggaaacgtgtaaggtgcagagcaatagagttttctgcgatacaatgaactccagaaccctgccttctgaggtgaatctctgcaacgtcgacatttttaatccgaaatatgattgtaagatcatgaccagcaaaacagacgtgtccagctctgtcattacctccctgggagccatcgtgagctgctacggcaagacaaaatgtacggcttctaacaagtgccgggggattatcaagaccttctccaatggatgtgattatgttagcaacaaaggcgtggacacagtctccgtgggcaataccctttactatgttaacaagcaagaggggaaatctctgtacgtgaagggagaacccatcattaatttttatgaccctctcgtcttccccagcgatgagtttgacgcctccatctctcaggtgaacgagaaaattaaccagagcctggctttcatccgcaagtccgatgaactgctccacaatgtgaacgccggcaagagcacaaccaatattatgatcacgaccattatcatcgttattatcgtcattctgctttctctgatcgccgtggggctcctgctgtactgcaaagctagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5982 - RNA, 1934 nt, synthetic construct
  misc_feature 1..1934: note = mRNA product Design g-4 comprising derived and/or modified sequence from HRSV(A2)__F-del_DSCav1_mut5 (opt6)
  source 1..1934: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaacttttaatactgaaagcaaatgccatcacaaccatactaactgccgtcacattctgctttgcatcaggacaaaacataacagaagaattttaccaatccacatgctcagcagtatcaaaaggatatctatcggcacttagaactggatggtacacaagtgttataactatagaactctcaaacataaaagaaaacaaatgcaatggaacagacgcaaaagtaaaactaataaaacaagaactcgataaatataaaaatgcagtaaccgaactacaactattaatgcaaagcacacccgcaacaggcagcggatcagcaatagcaagcggagtcgcagtatgtaaagtactacatctagaaggagaagtcaacaaaatcaaatctgcacttctatccacaaacaaagctgtagtatccctatccggatgcggagtctcagtattaacttttaaagtactagaccttaaaaactacatagataaacaactattaccaatactaaataaacaatcatgcagcatatccaatatagagacagtaattgaatttcaacaaaaaaacaacagattactagaaattactcgtgaattttccgtaaatgccggagtcacaacaccagtatcaacctatatgctaacaaacagcgaactacttagcttaataaatgacatgccaataacaaatgaccaaaaaaaacttatgtcaaataacgtacaaatcgtcagacaacaatcctactctataatgtgtataattaaagaagaagtcctagcatacgtagttcaattaccactctatggagtaatagatacaccatgctggaaactacacacgtcaccactatgtacaacaaacacaaaagaaggatccaatatatgcctaacaagaaccgacagaggctggtattgtgacaacgcaggatccgtttcattcttcccacaagcagaaacctgtaaagtacaatctaatagagtattttgcgacacaatgaacagtagaacactaccaagcgaggttaatctatgtaacgtagacatattcaatccaaaatatgattgcaaaataatgacatcaaaaacagatgtatcgtcgagtgtaataacaagtctgggagctatagtaagctgctacggcaagacgaaatgtaccgcttcaaataaatgcagaggaatcattaaaacattctcgaacggatgcgactacgtaagtaataaaggtgtcgacaccgtatcagtagggaatacattatactacgtcaacaaacaagaaggaaaatctctatatgtaaaaggagaaccaataataaatttctatgaccctctagtattcccatcagatgaatttgacgcttccatatcacaagtaaacgaaaaaatcaatcaatctttagcattcatacgaaaaagtgatgaactcctacacaacgtcaacgcaggaaaaagcacaacaaatataatgatcacaacaatcatcatagtaataatagtaatactactatcattaatagcagtaggattattgctttactgcaaagcacgatagggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5983 - RNA, 1934 nt, synthetic construct
  misc_feature 1..1934: note = mRNA product Design g-4 comprising derived and/or modified sequence from HRSV(A2)__F-del_DSCav1_mut5 (opt11)
  source 1..1934: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactcctcatcctcaaagccaacgccataaccacaatactcaccgccgtaaccttctgctttgcgtcgggacaaaacatcaccgaagagttctaccaatccacttgctccgcagtaagcaaaggatacctctccgccctgcgaaccggttggtacacatcagtcatcacaatcgaactctcaaacataaaagaaaacaaatgcaacggcaccgacgcaaaggtcaaattaatcaagcaagaactagacaaatacaaaaacgccgtcacagaactccagctgctaatgcagagcacacccgcaactggcagcggatccgccatcgcatcaggagtcgccgtgtgcaaagtcctacacctcgaaggagaagtgaacaaaatcaaatcagccctactctccaccaacaaggccgtcgtctccctctccggctgcggtgtctccgtcctaaccttcaaagtgctagacctcaagaactacatcgacaaacaactcctaccaatactcaacaagcaatcttgctccatctccaacatcgaaaccgtaatcgagttccaacagaagaacaaccgcctcctcgaaatcacccgcgagttctctgtcaacgcaggggtcaccactcccgtctccacatacatgctcacaaactccgaactcctcagcctcatcaacgacatgcccataaccaacgaccagaaaaagctaatgagcaataacgtccaaatcgttagacaacaaagttattccatcatgtgcatcatcaaagaagaagtcctcgcctacgtcgtacaactccccctctatggcgtcatcgacaccccctgctggaaactgcacacatcacccctctgcaccacaaacaccaaagaaggctcaaacatctgcctaactcgcaccgaccgcggctggtactgcgacaacgccggcagcgtatcattctttccccaagccgaaacatgcaaagttcaatccaaccgcgtcttctgcgacacaatgaactccagaacgctccccagcgaagtcaacctctgtaacgtagacatcttcaaccctaagtacgactgcaaaatcatgacctccaaaactgatgtatcctcctccgtcatcacatccctgggcgccatcgtcagctgctacggcaaaacaaaatgcactgcctcaaacaaatgccgaggtatcataaagaccttctcaaacggatgcgattacgtcagcaacaaaggcgtcgacaccgtcagtgtcggcaacaccctctactacgtcaacaaacaagaaggaaaatccctctacgtcaaaggcgaacccatcatcaacttctacgaccccctcgtcttccccagcgacgagttcgacgcctccatctcacaagtcaacgaaaagataaaccaatctctagccttcatccgcaaatccgatgaactcctgcataacgtcaacgccggcaaatccaccacaaacatcatgatcactaccataatcatcgtcataatcgtaatcctcctatctcttatcgcagtcggcctactactctactgcaaagcccgctaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5984 - RNA, 1910 nt, synthetic construct
  misc_feature 1..1910: note = mRNA product Design g-5 comprising derived and/or modified sequence from HRSV(A2)__F-del_DSCav1_mut5 (opt1)
  source 1..1910: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5985 - RNA, 1910 nt, synthetic construct
  misc_feature 1..1910: note = mRNA product Design g-5 comprising derived and/or modified sequence from HRSV(A2)__F-del_DSCav1_mut5 (opt1)
  source 1..1910: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcgggtgcggcgtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggggtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggcgtgatcgacacgccgtgctggaagctgcacaccagccccctctgcaccaccaacacgaaggaggggtccaacatctgcctgacccgcaccgaccggggctggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggggccatcgtgtcctgctacggcaagaccaagtgcaccgccagcaacaagtgccgggggatcatcaagaccttctccaacggctgcgactacgtgagcaacaagggcgtcgacacggtgagcgtggggaacaccctctactacgtcaacaagcaggagggcaagtccctgtacgtgaagggggagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccggcaagtccaccaccaacatcatgatcaccacgatcatcatcgtgatcatcgtcatcctcctgagcctgatcgccgtggggctcctgctgtactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5986 - RNA, 1910 nt, synthetic construct
  misc_feature 1..1910: note = mRNA product Design g-5 comprising derived and/or modified sequence from HRSV(A2)__F-del_DSCav1_mut5 (opt2)
  source 1..1910: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5987 - RNA, 1910 nt, synthetic construct
  misc_feature 1..1910: note = mRNA product Design g-5 comprising derived and/or modified sequence from HRSV(A2)__F-del_DSCav1_mut5 (opt3)
  source 1..1910: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcggttgcggggtgtccgtattaacttttaaggttctggaccttaagaactacattgataaacaattgctgcctatcctaaataagcagtcatgtagtattagcaacatcgagaccgtgatagagttccagcagaaaaataacaggctcctggaaattacacgggagttttctgtcaatgcgggagtgactaccccagtgtccacatatatgcttaccaactcagaactgttgagcctcatcaatgacatgccgattacgaacgatcaaaagaaactgatgagtaacaatgtccagatcgttcgccagcagtcttactccatcatgtgcattataaaggaggaagtgttagcatatgtagtgcaactgcccctctacggcgtcatcgacactccttgttggaaacttcatacaagcccactgtgcaccactaacacaaaggagggctcgaatatttgtttgacccgaacggatcgtgggtggtactgcgacaacgccggatctgtgtccttctttccccaggctgaaacctgtaaggttcagtcaaatagagtgttctgcgatacaatgaacagtagaactctgcctagcgaggtcaatctctgcaacgtggacatctttaatccaaaatatgattgtaagataatgacctccaaaacagacgtatctagctcagttattaccagtctgggtgccatcgtgtcctgctacggcaagactaaatgtacagcaagcaacaagtgcagggggatcattaagaccttctctaatggatgtgattatgtctcaaacaaaggcgtggacactgtcagtgtgggtaatacgctttactatgttaacaagcaagaggggaaaagcctgtacgtgaagggagaacccatcattaatttttatgaccctttggtattcccatccgatgagtttgacgcttctatatcgcaggtcaacgagaaaatcaaccagagcctcgccttcattcggaagtccgatgaactgttacacaatgtgaacgcgggcaagtcaacaaccaatatcatgatcactaccattataatcgttattatcgtgattctgctaagtctcatcgccgtcggcctgcttttgtactgcaaagcacgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5988 - RNA, 1910 nt, synthetic construct
  misc_feature 1..1910: note = mRNA product Design g-5 comprising derived and/or modified sequence from HRSV(A2)__F-del_DSCav1_mut5 (opt4)
  source 1..1910: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5989 - RNA, 1910 nt, synthetic construct
  misc_feature 1..1910: note = mRNA product Design g-5 comprising derived and/or modified sequence from HRSV(A2)__F-del_DSCav1_mut5 (opt5)
  source 1..1910: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcggatgcggcgtttctgtgctgacatttaaggtccttgacctgaagaactacattgataaacaactcctgcctatcctgaataagcagtcctgtagcatttctaacatcgagaccgtgattgagttccagcagaaaaataaccggctcctggaaatcacgcgcgagttttccgtgaatgccggcgtcacaaccccggttagcacatatatgcttaccaactccgaactgctctctctgatcaatgacatgcccattaccaacgatcaaaagaaacttatgagcaacaatgtgcagatcgtgagacagcagtcctacagcattatgtgcatcattaaggaggaagtcctggcttatgtggttcaactccctctgtacggggtgatcgacacaccctgttggaaactgcatacgtctcctctctgcaccacaaacaccaaggagggatccaatatctgtctgacacggaccgatcgcggctggtactgcgacaacgccgggagcgtctctttctttccccaggcggaaacgtgtaaggtgcagagcaatagagttttctgcgatacaatgaactccagaaccctgccttctgaggtgaatctctgcaacgtcgacatttttaatccgaaatatgattgtaagatcatgaccagcaaaacagacgtgtccagctctgtcattacctccctgggagccatcgtgagctgctacggcaagacaaaatgtacggcttctaacaagtgccgggggattatcaagaccttctccaatggatgtgattatgttagcaacaaaggcgtggacacagtctccgtgggcaataccctttactatgttaacaagcaagaggggaaatctctgtacgtgaagggagaacccatcattaatttttatgaccctctcgtcttccccagcgatgagtttgacgcctccatctctcaggtgaacgagaaaattaaccagagcctggctttcatccgcaagtccgatgaactgctccacaatgtgaacgccggcaagagcacaaccaatattatgatcacgaccattatcatcgttattatcgtcattctgctttctctgatcgccgtggggctcctgctgtactgcaaagctagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5990 - RNA, 1910 nt, synthetic construct
  misc_feature 1..1910: note = mRNA product Design g-5 comprising derived and/or modified sequence from HRSV(A2)__F-del_DSCav1_mut5 (opt6)
  source 1..1910: mol_type = other RNA
gggagacccgtgacccggaagttgtacggctacgcgactttccctcccacaaaccctcgcgcccttcctttcctacttgggcccggcagaaagcttaccatggaacttttaatactgaaagcaaatgccatcacaaccatactaactgccgtcacattctgctttgcatcaggacaaaacataacagaagaattttaccaatccacatgctcagcagtatcaaaaggatatctatcggcacttagaactggatggtacacaagtgttataactatagaactctcaaacataaaagaaaacaaatgcaatggaacagacgcaaaagtaaaactaataaaacaagaactcgataaatataaaaatgcagtaaccgaactacaactattaatgcaaagcacacccgcaacaggcagcggatcagcaatagcaagcggagtcgcagtatgtaaagtactacatctagaaggagaagtcaacaaaatcaaatctgcacttctatccacaaacaaagctgtagtatccctatccggatgcggagtctcagtattaacttttaaagtactagaccttaaaaactacatagataaacaactattaccaatactaaataaacaatcatgcagcatatccaatatagagacagtaattgaatttcaacaaaaaaacaacagattactagaaattactcgtgaattttccgtaaatgccggagtcacaacaccagtatcaacctatatgctaacaaacagcgaactacttagcttaataaatgacatgccaataacaaatgaccaaaaaaaacttatgtcaaataacgtacaaatcgtcagacaacaatcctactctataatgtgtataattaaagaagaagtcctagcatacgtagttcaattaccactctatggagtaatagatacaccatgctggaaactacacacgtcaccactatgtacaacaaacacaaaagaaggatccaatatatgcctaacaagaaccgacagaggctggtattgtgacaacgcaggatccgtttcattcttcccacaagcagaaacctgtaaagtacaatctaatagagtattttgcgacacaatgaacagtagaacactaccaagcgaggttaatctatgtaacgtagacatattcaatccaaaatatgattgcaaaataatgacatcaaaaacagatgtatcgtcgagtgtaataacaagtctgggagctatagtaagctgctacggcaagacgaaatgtaccgcttcaaataaatgcagaggaatcattaaaacattctcgaacggatgcgactacgtaagtaataaaggtgtcgacaccgtatcagtagggaatacattatactacgtcaacaaacaagaaggaaaatctctatatgtaaaaggagaaccaataataaatttctatgaccctctagtattcccatcagatgaatttgacgcttccatatcacaagtaaacgaaaaaatcaatcaatctttagcattcatacgaaaaagtgatgaactcctacacaacgtcaacgcaggaaaaagcacaacaaatataatgatcacaacaatcatcatagtaataatagtaatactactatcattaatagcagtaggattattgctttactgcaaagcacgatagggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5991 - RNA, 1910 nt, synthetic construct
  misc_feature 1..1910: note = mRNA product Design g-5 comprising derived and/or modified sequence from HRSV(A2)__F-del_DSCav1_mut5 (opt11)
  source 1..1910: mol_type = other RNA
gggagacccgtgacccggaagttgtacggctacgcgactttccctcccacaaaccctcgcgcccttcctttcctacttgggcccggcagaaagcttaccatggaactcctcatcctcaaagccaacgccataaccacaatactcaccgccgtaaccttctgctttgcgtcgggacaaaacatcaccgaagagttctaccaatccacttgctccgcagtaagcaaaggatacctctccgccctgcgaaccggttggtacacatcagtcatcacaatcgaactctcaaacataaaagaaaacaaatgcaacggcaccgacgcaaaggtcaaattaatcaagcaagaactagacaaatacaaaaacgccgtcacagaactccagctgctaatgcagagcacacccgcaactggcagcggatccgccatcgcatcaggagtcgccgtgtgcaaagtcctacacctcgaaggagaagtgaacaaaatcaaatcagccctactctccaccaacaaggccgtcgtctccctctccggctgcggtgtctccgtcctaaccttcaaagtgctagacctcaagaactacatcgacaaacaactcctaccaatactcaacaagcaatcttgctccatctccaacatcgaaaccgtaatcgagttccaacagaagaacaaccgcctcctcgaaatcacccgcgagttctctgtcaacgcaggggtcaccactcccgtctccacatacatgctcacaaactccgaactcctcagcctcatcaacgacatgcccataaccaacgaccagaaaaagctaatgagcaataacgtccaaatcgttagacaacaaagttattccatcatgtgcatcatcaaagaagaagtcctcgcctacgtcgtacaactccccctctatggcgtcatcgacaccccctgctggaaactgcacacatcacccctctgcaccacaaacaccaaagaaggctcaaacatctgcctaactcgcaccgaccgcggctggtactgcgacaacgccggcagcgtatcattctttccccaagccgaaacatgcaaagttcaatccaaccgcgtcttctgcgacacaatgaactccagaacgctccccagcgaagtcaacctctgtaacgtagacatcttcaaccctaagtacgactgcaaaatcatgacctccaaaactgatgtatcctcctccgtcatcacatccctgggcgccatcgtcagctgctacggcaaaacaaaatgcactgcctcaaacaaatgccgaggtatcataaagaccttctcaaacggatgcgattacgtcagcaacaaaggcgtcgacaccgtcagtgtcggcaacaccctctactacgtcaacaaacaagaaggaaaatccctctacgtcaaaggcgaacccatcatcaacttctacgaccccctcgtcttccccagcgacgagttcgacgcctccatctcacaagtcaacgaaaagataaaccaatctctagccttcatccgcaaatccgatgaactcctgcataacgtcaacgccggcaaatccaccacaaacatcatgatcactaccataatcatcgtcataatcgtaatcctcctatctcttatcgcagtcggcctactactctactgcaaagcccgctaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5992 - RNA, 1926 nt, synthetic construct
  misc_feature 1..1926: note = mRNA product Design h-1 comprising derived and/or modified sequence from HRSV(A2)__F-del_DSCav1_mut5 (opt1)
  source 1..1926: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5993 - RNA, 1926 nt, synthetic construct
  misc_feature 1..1926: note = mRNA product Design h-1 comprising derived and/or modified sequence from HRSV(A2)__F-del_DSCav1_mut5 (opt1)
  source 1..1926: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcgggtgcggcgtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggggtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggcgtgatcgacacgccgtgctggaagctgcacaccagccccctctgcaccaccaacacgaaggaggggtccaacatctgcctgacccgcaccgaccggggctggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggggccatcgtgtcctgctacggcaagaccaagtgcaccgccagcaacaagtgccgggggatcatcaagaccttctccaacggctgcgactacgtgagcaacaagggcgtcgacacggtgagcgtggggaacaccctctactacgtcaacaagcaggagggcaagtccctgtacgtgaagggggagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccggcaagtccaccaccaacatcatgatcaccacgatcatcatcgtgatcatcgtcatcctcctgagcctgatcgccgtggggctcctgctgtactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5994 - RNA, 1926 nt, synthetic construct
  misc_feature 1..1926: note = mRNA product Design h-1 comprising derived and/or modified sequence from HRSV(A2)__F-del_DSCav1_mut5 (opt2)
  source 1..1926: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5995 - RNA, 1926 nt, synthetic construct
  misc_feature 1..1926: note = mRNA product Design h-1 comprising derived and/or modified sequence from HRSV(A2)__F-del_DSCav1_mut5 (opt3)
  source 1..1926: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcggttgcggggtgtccgtattaacttttaaggttctggaccttaagaactacattgataaacaattgctgcctatcctaaataagcagtcatgtagtattagcaacatcgagaccgtgatagagttccagcagaaaaataacaggctcctggaaattacacgggagttttctgtcaatgcgggagtgactaccccagtgtccacatatatgcttaccaactcagaactgttgagcctcatcaatgacatgccgattacgaacgatcaaaagaaactgatgagtaacaatgtccagatcgttcgccagcagtcttactccatcatgtgcattataaaggaggaagtgttagcatatgtagtgcaactgcccctctacggcgtcatcgacactccttgttggaaacttcatacaagcccactgtgcaccactaacacaaaggagggctcgaatatttgtttgacccgaacggatcgtgggtggtactgcgacaacgccggatctgtgtccttctttccccaggctgaaacctgtaaggttcagtcaaatagagtgttctgcgatacaatgaacagtagaactctgcctagcgaggtcaatctctgcaacgtggacatctttaatccaaaatatgattgtaagataatgacctccaaaacagacgtatctagctcagttattaccagtctgggtgccatcgtgtcctgctacggcaagactaaatgtacagcaagcaacaagtgcagggggatcattaagaccttctctaatggatgtgattatgtctcaaacaaaggcgtggacactgtcagtgtgggtaatacgctttactatgttaacaagcaagaggggaaaagcctgtacgtgaagggagaacccatcattaatttttatgaccctttggtattcccatccgatgagtttgacgcttctatatcgcaggtcaacgagaaaatcaaccagagcctcgccttcattcggaagtccgatgaactgttacacaatgtgaacgcgggcaagtcaacaaccaatatcatgatcactaccattataatcgttattatcgtgattctgctaagtctcatcgccgtcggcctgcttttgtactgcaaagcacgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5996 - RNA, 1926 nt, synthetic construct
  misc_feature 1..1926: note = mRNA product Design h-1 comprising derived and/or modified sequence from HRSV(A2)__F-del_DSCav1_mut5 (opt4)
  source 1..1926: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5997 - RNA, 1926 nt, synthetic construct
  misc_feature 1..1926: note = mRNA product Design h-1 comprising derived and/or modified sequence from HRSV(A2)__F-del_DSCav1_mut5 (opt5)
  source 1..1926: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcggatgcggcgtttctgtgctgacatttaaggtccttgacctgaagaactacattgataaacaactcctgcctatcctgaataagcagtcctgtagcatttctaacatcgagaccgtgattgagttccagcagaaaaataaccggctcctggaaatcacgcgcgagttttccgtgaatgccggcgtcacaaccccggttagcacatatatgcttaccaactccgaactgctctctctgatcaatgacatgcccattaccaacgatcaaaagaaacttatgagcaacaatgtgcagatcgtgagacagcagtcctacagcattatgtgcatcattaaggaggaagtcctggcttatgtggttcaactccctctgtacggggtgatcgacacaccctgttggaaactgcatacgtctcctctctgcaccacaaacaccaaggagggatccaatatctgtctgacacggaccgatcgcggctggtactgcgacaacgccgggagcgtctctttctttccccaggcggaaacgtgtaaggtgcagagcaatagagttttctgcgatacaatgaactccagaaccctgccttctgaggtgaatctctgcaacgtcgacatttttaatccgaaatatgattgtaagatcatgaccagcaaaacagacgtgtccagctctgtcattacctccctgggagccatcgtgagctgctacggcaagacaaaatgtacggcttctaacaagtgccgggggattatcaagaccttctccaatggatgtgattatgttagcaacaaaggcgtggacacagtctccgtgggcaataccctttactatgttaacaagcaagaggggaaatctctgtacgtgaagggagaacccatcattaatttttatgaccctctcgtcttccccagcgatgagtttgacgcctccatctctcaggtgaacgagaaaattaaccagagcctggctttcatccgcaagtccgatgaactgctccacaatgtgaacgccggcaagagcacaaccaatattatgatcacgaccattatcatcgttattatcgtcattctgctttctctgatcgccgtggggctcctgctgtactgcaaagctagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5998 - RNA, 1926 nt, synthetic construct
  misc_feature 1..1926: note = mRNA product Design h-1 comprising derived and/or modified sequence from HRSV(A2)__F-del_DSCav1_mut5 (opt6)
  source 1..1926: mol_type = other RNA
gggagacccgtgacccggaagttgtacggctacgcgactttccctcccacaaaccctcgcgcccttcctttcctacttgggcccggcagaaagcttaccatggaacttttaatactgaaagcaaatgccatcacaaccatactaactgccgtcacattctgctttgcatcaggacaaaacataacagaagaattttaccaatccacatgctcagcagtatcaaaaggatatctatcggcacttagaactggatggtacacaagtgttataactatagaactctcaaacataaaagaaaacaaatgcaatggaacagacgcaaaagtaaaactaataaaacaagaactcgataaatataaaaatgcagtaaccgaactacaactattaatgcaaagcacacccgcaacaggcagcggatcagcaatagcaagcggagtcgcagtatgtaaagtactacatctagaaggagaagtcaacaaaatcaaatctgcacttctatccacaaacaaagctgtagtatccctatccggatgcggagtctcagtattaacttttaaagtactagaccttaaaaactacatagataaacaactattaccaatactaaataaacaatcatgcagcatatccaatatagagacagtaattgaatttcaacaaaaaaacaacagattactagaaattactcgtgaattttccgtaaatgccggagtcacaacaccagtatcaacctatatgctaacaaacagcgaactacttagcttaataaatgacatgccaataacaaatgaccaaaaaaaacttatgtcaaataacgtacaaatcgtcagacaacaatcctactctataatgtgtataattaaagaagaagtcctagcatacgtagttcaattaccactctatggagtaatagatacaccatgctggaaactacacacgtcaccactatgtacaacaaacacaaaagaaggatccaatatatgcctaacaagaaccgacagaggctggtattgtgacaacgcaggatccgtttcattcttcccacaagcagaaacctgtaaagtacaatctaatagagtattttgcgacacaatgaacagtagaacactaccaagcgaggttaatctatgtaacgtagacatattcaatccaaaatatgattgcaaaataatgacatcaaaaacagatgtatcgtcgagtgtaataacaagtctgggagctatagtaagctgctacggcaagacgaaatgtaccgcttcaaataaatgcagaggaatcattaaaacattctcgaacggatgcgactacgtaagtaataaaggtgtcgacaccgtatcagtagggaatacattatactacgtcaacaaacaagaaggaaaatctctatatgtaaaaggagaaccaataataaatttctatgaccctctagtattcccatcagatgaatttgacgcttccatatcacaagtaaacgaaaaaatcaatcaatctttagcattcatacgaaaaagtgatgaactcctacacaacgtcaacgcaggaaaaagcacaacaaatataatgatcacaacaatcatcatagtaataatagtaatactactatcattaatagcagtaggattattgctttactgcaaagcacgatagggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5999 - RNA, 1926 nt, synthetic construct
  misc_feature 1..1926: note = mRNA product Design h-1 comprising derived and/or modified sequence from HRSV(A2)__F-del_DSCav1_mut5 (opt11)
  source 1..1926: mol_type = other RNA
gggagacccgtgacccggaagttgtacggctacgcgactttccctcccacaaaccctcgcgcccttcctttcctacttgggcccggcagaaagcttaccatggaactcctcatcctcaaagccaacgccataaccacaatactcaccgccgtaaccttctgctttgcgtcgggacaaaacatcaccgaagagttctaccaatccacttgctccgcagtaagcaaaggatacctctccgccctgcgaaccggttggtacacatcagtcatcacaatcgaactctcaaacataaaagaaaacaaatgcaacggcaccgacgcaaaggtcaaattaatcaagcaagaactagacaaatacaaaaacgccgtcacagaactccagctgctaatgcagagcacacccgcaactggcagcggatccgccatcgcatcaggagtcgccgtgtgcaaagtcctacacctcgaaggagaagtgaacaaaatcaaatcagccctactctccaccaacaaggccgtcgtctccctctccggctgcggtgtctccgtcctaaccttcaaagtgctagacctcaagaactacatcgacaaacaactcctaccaatactcaacaagcaatcttgctccatctccaacatcgaaaccgtaatcgagttccaacagaagaacaaccgcctcctcgaaatcacccgcgagttctctgtcaacgcaggggtcaccactcccgtctccacatacatgctcacaaactccgaactcctcagcctcatcaacgacatgcccataaccaacgaccagaaaaagctaatgagcaataacgtccaaatcgttagacaacaaagttattccatcatgtgcatcatcaaagaagaagtcctcgcctacgtcgtacaactccccctctatggcgtcatcgacaccccctgctggaaactgcacacatcacccctctgcaccacaaacaccaaagaaggctcaaacatctgcctaactcgcaccgaccgcggctggtactgcgacaacgccggcagcgtatcattctttccccaagccgaaacatgcaaagttcaatccaaccgcgtcttctgcgacacaatgaactccagaacgctccccagcgaagtcaacctctgtaacgtagacatcttcaaccctaagtacgactgcaaaatcatgacctccaaaactgatgtatcctcctccgtcatcacatccctgggcgccatcgtcagctgctacggcaaaacaaaatgcactgcctcaaacaaatgccgaggtatcataaagaccttctcaaacggatgcgattacgtcagcaacaaaggcgtcgacaccgtcagtgtcggcaacaccctctactacgtcaacaaacaagaaggaaaatccctctacgtcaaaggcgaacccatcatcaacttctacgaccccctcgtcttccccagcgacgagttcgacgcctccatctcacaagtcaacgaaaagataaaccaatctctagccttcatccgcaaatccgatgaactcctgcataacgtcaacgccggcaaatccaccacaaacatcatgatcactaccataatcatcgtcataatcgtaatcctcctatctcttatcgcagtcggcctactactctactgcaaagcccgctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6000 - RNA, 2142 nt, synthetic construct
  misc_feature 1..2142: note = mRNA product Design h-2 comprising derived and/or modified sequence from HRSV(A2)__F-del_DSCav1_mut5 (opt1)
  source 1..2142: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6001 - RNA, 2142 nt, synthetic construct
  misc_feature 1..2142: note = mRNA product Design h-2 comprising derived and/or modified sequence from HRSV(A2)__F-del_DSCav1_mut5 (opt1)
  source 1..2142: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcgggtgcggcgtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggggtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggcgtgatcgacacgccgtgctggaagctgcacaccagccccctctgcaccaccaacacgaaggaggggtccaacatctgcctgacccgcaccgaccggggctggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggggccatcgtgtcctgctacggcaagaccaagtgcaccgccagcaacaagtgccgggggatcatcaagaccttctccaacggctgcgactacgtgagcaacaagggcgtcgacacggtgagcgtggggaacaccctctactacgtcaacaagcaggagggcaagtccctgtacgtgaagggggagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccggcaagtccaccaccaacatcatgatcaccacgatcatcatcgtgatcatcgtcatcctcctgagcctgatcgccgtggggctcctgctgtactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6002 - RNA, 2142 nt, synthetic construct
  misc_feature 1..2142: note = mRNA product Design h-2 comprising derived and/or modified sequence from HRSV(A2)__F-del_DSCav1_mut5 (opt2)
  source 1..2142: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6003 - RNA, 2142 nt, synthetic construct
  misc_feature 1..2142: note = mRNA product Design h-2 comprising derived and/or modified sequence from HRSV(A2)__F-del_DSCav1_mut5 (opt3)
  source 1..2142: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcggttgcggggtgtccgtattaacttttaaggttctggaccttaagaactacattgataaacaattgctgcctatcctaaataagcagtcatgtagtattagcaacatcgagaccgtgatagagttccagcagaaaaataacaggctcctggaaattacacgggagttttctgtcaatgcgggagtgactaccccagtgtccacatatatgcttaccaactcagaactgttgagcctcatcaatgacatgccgattacgaacgatcaaaagaaactgatgagtaacaatgtccagatcgttcgccagcagtcttactccatcatgtgcattataaaggaggaagtgttagcatatgtagtgcaactgcccctctacggcgtcatcgacactccttgttggaaacttcatacaagcccactgtgcaccactaacacaaaggagggctcgaatatttgtttgacccgaacggatcgtgggtggtactgcgacaacgccggatctgtgtccttctttccccaggctgaaacctgtaaggttcagtcaaatagagtgttctgcgatacaatgaacagtagaactctgcctagcgaggtcaatctctgcaacgtggacatctttaatccaaaatatgattgtaagataatgacctccaaaacagacgtatctagctcagttattaccagtctgggtgccatcgtgtcctgctacggcaagactaaatgtacagcaagcaacaagtgcagggggatcattaagaccttctctaatggatgtgattatgtctcaaacaaaggcgtggacactgtcagtgtgggtaatacgctttactatgttaacaagcaagaggggaaaagcctgtacgtgaagggagaacccatcattaatttttatgaccctttggtattcccatccgatgagtttgacgcttctatatcgcaggtcaacgagaaaatcaaccagagcctcgccttcattcggaagtccgatgaactgttacacaatgtgaacgcgggcaagtcaacaaccaatatcatgatcactaccattataatcgttattatcgtgattctgctaagtctcatcgccgtcggcctgcttttgtactgcaaagcacgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6004 - RNA, 2142 nt, synthetic construct
  misc_feature 1..2142: note = mRNA product Design h-2 comprising derived and/or modified sequence from HRSV(A2)__F-del_DSCav1_mut5 (opt4)
  source 1..2142: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6005 - RNA, 2142 nt, synthetic construct
  misc_feature 1..2142: note = mRNA product Design h-2 comprising derived and/or modified sequence from HRSV(A2)__F-del_DSCav1_mut5 (opt5)
  source 1..2142: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcggatgcggcgtttctgtgctgacatttaaggtccttgacctgaagaactacattgataaacaactcctgcctatcctgaataagcagtcctgtagcatttctaacatcgagaccgtgattgagttccagcagaaaaataaccggctcctggaaatcacgcgcgagttttccgtgaatgccggcgtcacaaccccggttagcacatatatgcttaccaactccgaactgctctctctgatcaatgacatgcccattaccaacgatcaaaagaaacttatgagcaacaatgtgcagatcgtgagacagcagtcctacagcattatgtgcatcattaaggaggaagtcctggcttatgtggttcaactccctctgtacggggtgatcgacacaccctgttggaaactgcatacgtctcctctctgcaccacaaacaccaaggagggatccaatatctgtctgacacggaccgatcgcggctggtactgcgacaacgccgggagcgtctctttctttccccaggcggaaacgtgtaaggtgcagagcaatagagttttctgcgatacaatgaactccagaaccctgccttctgaggtgaatctctgcaacgtcgacatttttaatccgaaatatgattgtaagatcatgaccagcaaaacagacgtgtccagctctgtcattacctccctgggagccatcgtgagctgctacggcaagacaaaatgtacggcttctaacaagtgccgggggattatcaagaccttctccaatggatgtgattatgttagcaacaaaggcgtggacacagtctccgtgggcaataccctttactatgttaacaagcaagaggggaaatctctgtacgtgaagggagaacccatcattaatttttatgaccctctcgtcttccccagcgatgagtttgacgcctccatctctcaggtgaacgagaaaattaaccagagcctggctttcatccgcaagtccgatgaactgctccacaatgtgaacgccggcaagagcacaaccaatattatgatcacgaccattatcatcgttattatcgtcattctgctttctctgatcgccgtggggctcctgctgtactgcaaagctagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6006 - RNA, 2142 nt, synthetic construct
  misc_feature 1..2142: note = mRNA product Design h-2 comprising derived and/or modified sequence from HRSV(A2)__F-del_DSCav1_mut5 (opt6)
  source 1..2142: mol_type = other RNA
gggagacccgtgacccggaagttgtacggctacgcgactttccctcccacaaaccctcgcgcccttcctttcctacttgggcccggcagaaagcttaccatggaacttttaatactgaaagcaaatgccatcacaaccatactaactgccgtcacattctgctttgcatcaggacaaaacataacagaagaattttaccaatccacatgctcagcagtatcaaaaggatatctatcggcacttagaactggatggtacacaagtgttataactatagaactctcaaacataaaagaaaacaaatgcaatggaacagacgcaaaagtaaaactaataaaacaagaactcgataaatataaaaatgcagtaaccgaactacaactattaatgcaaagcacacccgcaacaggcagcggatcagcaatagcaagcggagtcgcagtatgtaaagtactacatctagaaggagaagtcaacaaaatcaaatctgcacttctatccacaaacaaagctgtagtatccctatccggatgcggagtctcagtattaacttttaaagtactagaccttaaaaactacatagataaacaactattaccaatactaaataaacaatcatgcagcatatccaatatagagacagtaattgaatttcaacaaaaaaacaacagattactagaaattactcgtgaattttccgtaaatgccggagtcacaacaccagtatcaacctatatgctaacaaacagcgaactacttagcttaataaatgacatgccaataacaaatgaccaaaaaaaacttatgtcaaataacgtacaaatcgtcagacaacaatcctactctataatgtgtataattaaagaagaagtcctagcatacgtagttcaattaccactctatggagtaatagatacaccatgctggaaactacacacgtcaccactatgtacaacaaacacaaaagaaggatccaatatatgcctaacaagaaccgacagaggctggtattgtgacaacgcaggatccgtttcattcttcccacaagcagaaacctgtaaagtacaatctaatagagtattttgcgacacaatgaacagtagaacactaccaagcgaggttaatctatgtaacgtagacatattcaatccaaaatatgattgcaaaataatgacatcaaaaacagatgtatcgtcgagtgtaataacaagtctgggagctatagtaagctgctacggcaagacgaaatgtaccgcttcaaataaatgcagaggaatcattaaaacattctcgaacggatgcgactacgtaagtaataaaggtgtcgacaccgtatcagtagggaatacattatactacgtcaacaaacaagaaggaaaatctctatatgtaaaaggagaaccaataataaatttctatgaccctctagtattcccatcagatgaatttgacgcttccatatcacaagtaaacgaaaaaatcaatcaatctttagcattcatacgaaaaagtgatgaactcctacacaacgtcaacgcaggaaaaagcacaacaaatataatgatcacaacaatcatcatagtaataatagtaatactactatcattaatagcagtaggattattgctttactgcaaagcacgatagggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6007 - RNA, 2142 nt, synthetic construct
  misc_feature 1..2142: note = mRNA product Design h-2 comprising derived and/or modified sequence from HRSV(A2)__F-del_DSCav1_mut5 (opt11)
  source 1..2142: mol_type = other RNA
gggagacccgtgacccggaagttgtacggctacgcgactttccctcccacaaaccctcgcgcccttcctttcctacttgggcccggcagaaagcttaccatggaactcctcatcctcaaagccaacgccataaccacaatactcaccgccgtaaccttctgctttgcgtcgggacaaaacatcaccgaagagttctaccaatccacttgctccgcagtaagcaaaggatacctctccgccctgcgaaccggttggtacacatcagtcatcacaatcgaactctcaaacataaaagaaaacaaatgcaacggcaccgacgcaaaggtcaaattaatcaagcaagaactagacaaatacaaaaacgccgtcacagaactccagctgctaatgcagagcacacccgcaactggcagcggatccgccatcgcatcaggagtcgccgtgtgcaaagtcctacacctcgaaggagaagtgaacaaaatcaaatcagccctactctccaccaacaaggccgtcgtctccctctccggctgcggtgtctccgtcctaaccttcaaagtgctagacctcaagaactacatcgacaaacaactcctaccaatactcaacaagcaatcttgctccatctccaacatcgaaaccgtaatcgagttccaacagaagaacaaccgcctcctcgaaatcacccgcgagttctctgtcaacgcaggggtcaccactcccgtctccacatacatgctcacaaactccgaactcctcagcctcatcaacgacatgcccataaccaacgaccagaaaaagctaatgagcaataacgtccaaatcgttagacaacaaagttattccatcatgtgcatcatcaaagaagaagtcctcgcctacgtcgtacaactccccctctatggcgtcatcgacaccccctgctggaaactgcacacatcacccctctgcaccacaaacaccaaagaaggctcaaacatctgcctaactcgcaccgaccgcggctggtactgcgacaacgccggcagcgtatcattctttccccaagccgaaacatgcaaagttcaatccaaccgcgtcttctgcgacacaatgaactccagaacgctccccagcgaagtcaacctctgtaacgtagacatcttcaaccctaagtacgactgcaaaatcatgacctccaaaactgatgtatcctcctccgtcatcacatccctgggcgccatcgtcagctgctacggcaaaacaaaatgcactgcctcaaacaaatgccgaggtatcataaagaccttctcaaacggatgcgattacgtcagcaacaaaggcgtcgacaccgtcagtgtcggcaacaccctctactacgtcaacaaacaagaaggaaaatccctctacgtcaaaggcgaacccatcatcaacttctacgaccccctcgtcttccccagcgacgagttcgacgcctccatctcacaagtcaacgaaaagataaaccaatctctagccttcatccgcaaatccgatgaactcctgcataacgtcaacgccggcaaatccaccacaaacatcatgatcactaccataatcatcgtcataatcgtaatcctcctatctcttatcgcagtcggcctactactctactgcaaagcccgctaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6008 - RNA, 1922 nt, synthetic construct
  misc_feature 1..1922: note = mRNA product Design h-3 comprising derived and/or modified sequence from HRSV(A2)__F-del_DSCav1_mut5 (opt1)
  source 1..1922: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6009 - RNA, 1922 nt, synthetic construct
  misc_feature 1..1922: note = mRNA product Design h-3 comprising derived and/or modified sequence from HRSV(A2)__F-del_DSCav1_mut5 (opt1)
  source 1..1922: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcgggtgcggcgtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggggtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggcgtgatcgacacgccgtgctggaagctgcacaccagccccctctgcaccaccaacacgaaggaggggtccaacatctgcctgacccgcaccgaccggggctggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggggccatcgtgtcctgctacggcaagaccaagtgcaccgccagcaacaagtgccgggggatcatcaagaccttctccaacggctgcgactacgtgagcaacaagggcgtcgacacggtgagcgtggggaacaccctctactacgtcaacaagcaggagggcaagtccctgtacgtgaagggggagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccggcaagtccaccaccaacatcatgatcaccacgatcatcatcgtgatcatcgtcatcctcctgagcctgatcgccgtggggctcctgctgtactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6010 - RNA, 1922 nt, synthetic construct
  misc_feature 1..1922: note = mRNA product Design h-3 comprising derived and/or modified sequence from HRSV(A2)__F-del_DSCav1_mut5 (opt2)
  source 1..1922: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6011 - RNA, 1922 nt, synthetic construct
  misc_feature 1..1922: note = mRNA product Design h-3 comprising derived and/or modified sequence from HRSV(A2)__F-del_DSCav1_mut5 (opt3)
  source 1..1922: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcggttgcggggtgtccgtattaacttttaaggttctggaccttaagaactacattgataaacaattgctgcctatcctaaataagcagtcatgtagtattagcaacatcgagaccgtgatagagttccagcagaaaaataacaggctcctggaaattacacgggagttttctgtcaatgcgggagtgactaccccagtgtccacatatatgcttaccaactcagaactgttgagcctcatcaatgacatgccgattacgaacgatcaaaagaaactgatgagtaacaatgtccagatcgttcgccagcagtcttactccatcatgtgcattataaaggaggaagtgttagcatatgtagtgcaactgcccctctacggcgtcatcgacactccttgttggaaacttcatacaagcccactgtgcaccactaacacaaaggagggctcgaatatttgtttgacccgaacggatcgtgggtggtactgcgacaacgccggatctgtgtccttctttccccaggctgaaacctgtaaggttcagtcaaatagagtgttctgcgatacaatgaacagtagaactctgcctagcgaggtcaatctctgcaacgtggacatctttaatccaaaatatgattgtaagataatgacctccaaaacagacgtatctagctcagttattaccagtctgggtgccatcgtgtcctgctacggcaagactaaatgtacagcaagcaacaagtgcagggggatcattaagaccttctctaatggatgtgattatgtctcaaacaaaggcgtggacactgtcagtgtgggtaatacgctttactatgttaacaagcaagaggggaaaagcctgtacgtgaagggagaacccatcattaatttttatgaccctttggtattcccatccgatgagtttgacgcttctatatcgcaggtcaacgagaaaatcaaccagagcctcgccttcattcggaagtccgatgaactgttacacaatgtgaacgcgggcaagtcaacaaccaatatcatgatcactaccattataatcgttattatcgtgattctgctaagtctcatcgccgtcggcctgcttttgtactgcaaagcacgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6012 - RNA, 1922 nt, synthetic construct
  misc_feature 1..1922: note = mRNA product Design h-3 comprising derived and/or modified sequence from HRSV(A2)__F-del_DSCav1_mut5 (opt4)
  source 1..1922: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6013 - RNA, 1922 nt, synthetic construct
  misc_feature 1..1922: note = mRNA product Design h-3 comprising derived and/or modified sequence from HRSV(A2)__F-del_DSCav1_mut5 (opt5)
  source 1..1922: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcggatgcggcgtttctgtgctgacatttaaggtccttgacctgaagaactacattgataaacaactcctgcctatcctgaataagcagtcctgtagcatttctaacatcgagaccgtgattgagttccagcagaaaaataaccggctcctggaaatcacgcgcgagttttccgtgaatgccggcgtcacaaccccggttagcacatatatgcttaccaactccgaactgctctctctgatcaatgacatgcccattaccaacgatcaaaagaaacttatgagcaacaatgtgcagatcgtgagacagcagtcctacagcattatgtgcatcattaaggaggaagtcctggcttatgtggttcaactccctctgtacggggtgatcgacacaccctgttggaaactgcatacgtctcctctctgcaccacaaacaccaaggagggatccaatatctgtctgacacggaccgatcgcggctggtactgcgacaacgccgggagcgtctctttctttccccaggcggaaacgtgtaaggtgcagagcaatagagttttctgcgatacaatgaactccagaaccctgccttctgaggtgaatctctgcaacgtcgacatttttaatccgaaatatgattgtaagatcatgaccagcaaaacagacgtgtccagctctgtcattacctccctgggagccatcgtgagctgctacggcaagacaaaatgtacggcttctaacaagtgccgggggattatcaagaccttctccaatggatgtgattatgttagcaacaaaggcgtggacacagtctccgtgggcaataccctttactatgttaacaagcaagaggggaaatctctgtacgtgaagggagaacccatcattaatttttatgaccctctcgtcttccccagcgatgagtttgacgcctccatctctcaggtgaacgagaaaattaaccagagcctggctttcatccgcaagtccgatgaactgctccacaatgtgaacgccggcaagagcacaaccaatattatgatcacgaccattatcatcgttattatcgtcattctgctttctctgatcgccgtggggctcctgctgtactgcaaagctagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6014 - RNA, 1922 nt, synthetic construct
  misc_feature 1..1922: note = mRNA product Design h-3 comprising derived and/or modified sequence from HRSV(A2)__F-del_DSCav1_mut5 (opt6)
  source 1..1922: mol_type = other RNA
gggagacccgtgacccggaagttgtacggctacgcgactttccctcccacaaaccctcgcgcccttcctttcctacttgggcccggcagaaagcttaccatggaacttttaatactgaaagcaaatgccatcacaaccatactaactgccgtcacattctgctttgcatcaggacaaaacataacagaagaattttaccaatccacatgctcagcagtatcaaaaggatatctatcggcacttagaactggatggtacacaagtgttataactatagaactctcaaacataaaagaaaacaaatgcaatggaacagacgcaaaagtaaaactaataaaacaagaactcgataaatataaaaatgcagtaaccgaactacaactattaatgcaaagcacacccgcaacaggcagcggatcagcaatagcaagcggagtcgcagtatgtaaagtactacatctagaaggagaagtcaacaaaatcaaatctgcacttctatccacaaacaaagctgtagtatccctatccggatgcggagtctcagtattaacttttaaagtactagaccttaaaaactacatagataaacaactattaccaatactaaataaacaatcatgcagcatatccaatatagagacagtaattgaatttcaacaaaaaaacaacagattactagaaattactcgtgaattttccgtaaatgccggagtcacaacaccagtatcaacctatatgctaacaaacagcgaactacttagcttaataaatgacatgccaataacaaatgaccaaaaaaaacttatgtcaaataacgtacaaatcgtcagacaacaatcctactctataatgtgtataattaaagaagaagtcctagcatacgtagttcaattaccactctatggagtaatagatacaccatgctggaaactacacacgtcaccactatgtacaacaaacacaaaagaaggatccaatatatgcctaacaagaaccgacagaggctggtattgtgacaacgcaggatccgtttcattcttcccacaagcagaaacctgtaaagtacaatctaatagagtattttgcgacacaatgaacagtagaacactaccaagcgaggttaatctatgtaacgtagacatattcaatccaaaatatgattgcaaaataatgacatcaaaaacagatgtatcgtcgagtgtaataacaagtctgggagctatagtaagctgctacggcaagacgaaatgtaccgcttcaaataaatgcagaggaatcattaaaacattctcgaacggatgcgactacgtaagtaataaaggtgtcgacaccgtatcagtagggaatacattatactacgtcaacaaacaagaaggaaaatctctatatgtaaaaggagaaccaataataaatttctatgaccctctagtattcccatcagatgaatttgacgcttccatatcacaagtaaacgaaaaaatcaatcaatctttagcattcatacgaaaaagtgatgaactcctacacaacgtcaacgcaggaaaaagcacaacaaatataatgatcacaacaatcatcatagtaataatagtaatactactatcattaatagcagtaggattattgctttactgcaaagcacgatagggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6015 - RNA, 1922 nt, synthetic construct
  misc_feature 1..1922: note = mRNA product Design h-3 comprising derived and/or modified sequence from HRSV(A2)__F-del_DSCav1_mut5 (opt11)
  source 1..1922: mol_type = other RNA
gggagacccgtgacccggaagttgtacggctacgcgactttccctcccacaaaccctcgcgcccttcctttcctacttgggcccggcagaaagcttaccatggaactcctcatcctcaaagccaacgccataaccacaatactcaccgccgtaaccttctgctttgcgtcgggacaaaacatcaccgaagagttctaccaatccacttgctccgcagtaagcaaaggatacctctccgccctgcgaaccggttggtacacatcagtcatcacaatcgaactctcaaacataaaagaaaacaaatgcaacggcaccgacgcaaaggtcaaattaatcaagcaagaactagacaaatacaaaaacgccgtcacagaactccagctgctaatgcagagcacacccgcaactggcagcggatccgccatcgcatcaggagtcgccgtgtgcaaagtcctacacctcgaaggagaagtgaacaaaatcaaatcagccctactctccaccaacaaggccgtcgtctccctctccggctgcggtgtctccgtcctaaccttcaaagtgctagacctcaagaactacatcgacaaacaactcctaccaatactcaacaagcaatcttgctccatctccaacatcgaaaccgtaatcgagttccaacagaagaacaaccgcctcctcgaaatcacccgcgagttctctgtcaacgcaggggtcaccactcccgtctccacatacatgctcacaaactccgaactcctcagcctcatcaacgacatgcccataaccaacgaccagaaaaagctaatgagcaataacgtccaaatcgttagacaacaaagttattccatcatgtgcatcatcaaagaagaagtcctcgcctacgtcgtacaactccccctctatggcgtcatcgacaccccctgctggaaactgcacacatcacccctctgcaccacaaacaccaaagaaggctcaaacatctgcctaactcgcaccgaccgcggctggtactgcgacaacgccggcagcgtatcattctttccccaagccgaaacatgcaaagttcaatccaaccgcgtcttctgcgacacaatgaactccagaacgctccccagcgaagtcaacctctgtaacgtagacatcttcaaccctaagtacgactgcaaaatcatgacctccaaaactgatgtatcctcctccgtcatcacatccctgggcgccatcgtcagctgctacggcaaaacaaaatgcactgcctcaaacaaatgccgaggtatcataaagaccttctcaaacggatgcgattacgtcagcaacaaaggcgtcgacaccgtcagtgtcggcaacaccctctactacgtcaacaaacaagaaggaaaatccctctacgtcaaaggcgaacccatcatcaacttctacgaccccctcgtcttccccagcgacgagttcgacgcctccatctcacaagtcaacgaaaagataaaccaatctctagccttcatccgcaaatccgatgaactcctgcataacgtcaacgccggcaaatccaccacaaacatcatgatcactaccataatcatcgtcataatcgtaatcctcctatctcttatcgcagtcggcctactactctactgcaaagcccgctaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6016 - RNA, 1985 nt, synthetic construct
  misc_feature 1..1985: note = mRNA product Design h-4 comprising derived and/or modified sequence from HRSV(A2)__F-del_DSCav1_mut5 (opt1)
  source 1..1985: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6017 - RNA, 1985 nt, synthetic construct
  misc_feature 1..1985: note = mRNA product Design h-4 comprising derived and/or modified sequence from HRSV(A2)__F-del_DSCav1_mut5 (opt1)
  source 1..1985: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcgggtgcggcgtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggggtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggcgtgatcgacacgccgtgctggaagctgcacaccagccccctctgcaccaccaacacgaaggaggggtccaacatctgcctgacccgcaccgaccggggctggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggggccatcgtgtcctgctacggcaagaccaagtgcaccgccagcaacaagtgccgggggatcatcaagaccttctccaacggctgcgactacgtgagcaacaagggcgtcgacacggtgagcgtggggaacaccctctactacgtcaacaagcaggagggcaagtccctgtacgtgaagggggagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccggcaagtccaccaccaacatcatgatcaccacgatcatcatcgtgatcatcgtcatcctcctgagcctgatcgccgtggggctcctgctgtactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6018 - RNA, 1985 nt, synthetic construct
  misc_feature 1..1985: note = mRNA product Design h-4 comprising derived and/or modified sequence from HRSV(A2)__F-del_DSCav1_mut5 (opt2)
  source 1..1985: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6019 - RNA, 1985 nt, synthetic construct
  misc_feature 1..1985: note = mRNA product Design h-4 comprising derived and/or modified sequence from HRSV(A2)__F-del_DSCav1_mut5 (opt3)
  source 1..1985: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcggttgcggggtgtccgtattaacttttaaggttctggaccttaagaactacattgataaacaattgctgcctatcctaaataagcagtcatgtagtattagcaacatcgagaccgtgatagagttccagcagaaaaataacaggctcctggaaattacacgggagttttctgtcaatgcgggagtgactaccccagtgtccacatatatgcttaccaactcagaactgttgagcctcatcaatgacatgccgattacgaacgatcaaaagaaactgatgagtaacaatgtccagatcgttcgccagcagtcttactccatcatgtgcattataaaggaggaagtgttagcatatgtagtgcaactgcccctctacggcgtcatcgacactccttgttggaaacttcatacaagcccactgtgcaccactaacacaaaggagggctcgaatatttgtttgacccgaacggatcgtgggtggtactgcgacaacgccggatctgtgtccttctttccccaggctgaaacctgtaaggttcagtcaaatagagtgttctgcgatacaatgaacagtagaactctgcctagcgaggtcaatctctgcaacgtggacatctttaatccaaaatatgattgtaagataatgacctccaaaacagacgtatctagctcagttattaccagtctgggtgccatcgtgtcctgctacggcaagactaaatgtacagcaagcaacaagtgcagggggatcattaagaccttctctaatggatgtgattatgtctcaaacaaaggcgtggacactgtcagtgtgggtaatacgctttactatgttaacaagcaagaggggaaaagcctgtacgtgaagggagaacccatcattaatttttatgaccctttggtattcccatccgatgagtttgacgcttctatatcgcaggtcaacgagaaaatcaaccagagcctcgccttcattcggaagtccgatgaactgttacacaatgtgaacgcgggcaagtcaacaaccaatatcatgatcactaccattataatcgttattatcgtgattctgctaagtctcatcgccgtcggcctgcttttgtactgcaaagcacgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6020 - RNA, 1985 nt, synthetic construct
  misc_feature 1..1985: note = mRNA product Design h-4 comprising derived and/or modified sequence from HRSV(A2)__F-del_DSCav1_mut5 (opt4)
  source 1..1985: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6021 - RNA, 1985 nt, synthetic construct
  misc_feature 1..1985: note = mRNA product Design h-4 comprising derived and/or modified sequence from HRSV(A2)__F-del_DSCav1_mut5 (opt5)
  source 1..1985: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcggatgcggcgtttctgtgctgacatttaaggtccttgacctgaagaactacattgataaacaactcctgcctatcctgaataagcagtcctgtagcatttctaacatcgagaccgtgattgagttccagcagaaaaataaccggctcctggaaatcacgcgcgagttttccgtgaatgccggcgtcacaaccccggttagcacatatatgcttaccaactccgaactgctctctctgatcaatgacatgcccattaccaacgatcaaaagaaacttatgagcaacaatgtgcagatcgtgagacagcagtcctacagcattatgtgcatcattaaggaggaagtcctggcttatgtggttcaactccctctgtacggggtgatcgacacaccctgttggaaactgcatacgtctcctctctgcaccacaaacaccaaggagggatccaatatctgtctgacacggaccgatcgcggctggtactgcgacaacgccgggagcgtctctttctttccccaggcggaaacgtgtaaggtgcagagcaatagagttttctgcgatacaatgaactccagaaccctgccttctgaggtgaatctctgcaacgtcgacatttttaatccgaaatatgattgtaagatcatgaccagcaaaacagacgtgtccagctctgtcattacctccctgggagccatcgtgagctgctacggcaagacaaaatgtacggcttctaacaagtgccgggggattatcaagaccttctccaatggatgtgattatgttagcaacaaaggcgtggacacagtctccgtgggcaataccctttactatgttaacaagcaagaggggaaatctctgtacgtgaagggagaacccatcattaatttttatgaccctctcgtcttccccagcgatgagtttgacgcctccatctctcaggtgaacgagaaaattaaccagagcctggctttcatccgcaagtccgatgaactgctccacaatgtgaacgccggcaagagcacaaccaatattatgatcacgaccattatcatcgttattatcgtcattctgctttctctgatcgccgtggggctcctgctgtactgcaaagctagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6022 - RNA, 1985 nt, synthetic construct
  misc_feature 1..1985: note = mRNA product Design h-4 comprising derived and/or modified sequence from HRSV(A2)__F-del_DSCav1_mut5 (opt6)
  source 1..1985: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaacttttaatactgaaagcaaatgccatcacaaccatactaactgccgtcacattctgctttgcatcaggacaaaacataacagaagaattttaccaatccacatgctcagcagtatcaaaaggatatctatcggcacttagaactggatggtacacaagtgttataactatagaactctcaaacataaaagaaaacaaatgcaatggaacagacgcaaaagtaaaactaataaaacaagaactcgataaatataaaaatgcagtaaccgaactacaactattaatgcaaagcacacccgcaacaggcagcggatcagcaatagcaagcggagtcgcagtatgtaaagtactacatctagaaggagaagtcaacaaaatcaaatctgcacttctatccacaaacaaagctgtagtatccctatccggatgcggagtctcagtattaacttttaaagtactagaccttaaaaactacatagataaacaactattaccaatactaaataaacaatcatgcagcatatccaatatagagacagtaattgaatttcaacaaaaaaacaacagattactagaaattactcgtgaattttccgtaaatgccggagtcacaacaccagtatcaacctatatgctaacaaacagcgaactacttagcttaataaatgacatgccaataacaaatgaccaaaaaaaacttatgtcaaataacgtacaaatcgtcagacaacaatcctactctataatgtgtataattaaagaagaagtcctagcatacgtagttcaattaccactctatggagtaatagatacaccatgctggaaactacacacgtcaccactatgtacaacaaacacaaaagaaggatccaatatatgcctaacaagaaccgacagaggctggtattgtgacaacgcaggatccgtttcattcttcccacaagcagaaacctgtaaagtacaatctaatagagtattttgcgacacaatgaacagtagaacactaccaagcgaggttaatctatgtaacgtagacatattcaatccaaaatatgattgcaaaataatgacatcaaaaacagatgtatcgtcgagtgtaataacaagtctgggagctatagtaagctgctacggcaagacgaaatgtaccgcttcaaataaatgcagaggaatcattaaaacattctcgaacggatgcgactacgtaagtaataaaggtgtcgacaccgtatcagtagggaatacattatactacgtcaacaaacaagaaggaaaatctctatatgtaaaaggagaaccaataataaatttctatgaccctctagtattcccatcagatgaatttgacgcttccatatcacaagtaaacgaaaaaatcaatcaatctttagcattcatacgaaaaagtgatgaactcctacacaacgtcaacgcaggaaaaagcacaacaaatataatgatcacaacaatcatcatagtaataatagtaatactactatcattaatagcagtaggattattgctttactgcaaagcacgatagggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6023 - RNA, 1985 nt, synthetic construct
  misc_feature 1..1985: note = mRNA product Design h-4 comprising derived and/or modified sequence from HRSV(A2)__F-del_DSCav1_mut5 (opt11)
  source 1..1985: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcctcatcctcaaagccaacgccataaccacaatactcaccgccgtaaccttctgctttgcgtcgggacaaaacatcaccgaagagttctaccaatccacttgctccgcagtaagcaaaggatacctctccgccctgcgaaccggttggtacacatcagtcatcacaatcgaactctcaaacataaaagaaaacaaatgcaacggcaccgacgcaaaggtcaaattaatcaagcaagaactagacaaatacaaaaacgccgtcacagaactccagctgctaatgcagagcacacccgcaactggcagcggatccgccatcgcatcaggagtcgccgtgtgcaaagtcctacacctcgaaggagaagtgaacaaaatcaaatcagccctactctccaccaacaaggccgtcgtctccctctccggctgcggtgtctccgtcctaaccttcaaagtgctagacctcaagaactacatcgacaaacaactcctaccaatactcaacaagcaatcttgctccatctccaacatcgaaaccgtaatcgagttccaacagaagaacaaccgcctcctcgaaatcacccgcgagttctctgtcaacgcaggggtcaccactcccgtctccacatacatgctcacaaactccgaactcctcagcctcatcaacgacatgcccataaccaacgaccagaaaaagctaatgagcaataacgtccaaatcgttagacaacaaagttattccatcatgtgcatcatcaaagaagaagtcctcgcctacgtcgtacaactccccctctatggcgtcatcgacaccccctgctggaaactgcacacatcacccctctgcaccacaaacaccaaagaaggctcaaacatctgcctaactcgcaccgaccgcggctggtactgcgacaacgccggcagcgtatcattctttccccaagccgaaacatgcaaagttcaatccaaccgcgtcttctgcgacacaatgaactccagaacgctccccagcgaagtcaacctctgtaacgtagacatcttcaaccctaagtacgactgcaaaatcatgacctccaaaactgatgtatcctcctccgtcatcacatccctgggcgccatcgtcagctgctacggcaaaacaaaatgcactgcctcaaacaaatgccgaggtatcataaagaccttctcaaacggatgcgattacgtcagcaacaaaggcgtcgacaccgtcagtgtcggcaacaccctctactacgtcaacaaacaagaaggaaaatccctctacgtcaaaggcgaacccatcatcaacttctacgaccccctcgtcttccccagcgacgagttcgacgcctccatctcacaagtcaacgaaaagataaaccaatctctagccttcatccgcaaatccgatgaactcctgcataacgtcaacgccggcaaatccaccacaaacatcatgatcactaccataatcatcgtcataatcgtaatcctcctatctcttatcgcagtcggcctactactctactgcaaagcccgctaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6024 - RNA, 2001 nt, synthetic construct
  misc_feature 1..2001: note = mRNA product Design h-5 comprising derived and/or modified sequence from HRSV(A2)__F-del_DSCav1_mut5 (opt1)
  source 1..2001: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6025 - RNA, 2001 nt, synthetic construct
  misc_feature 1..2001: note = mRNA product Design h-5 comprising derived and/or modified sequence from HRSV(A2)__F-del_DSCav1_mut5 (opt1)
  source 1..2001: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcgggtgcggcgtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggggtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggcgtgatcgacacgccgtgctggaagctgcacaccagccccctctgcaccaccaacacgaaggaggggtccaacatctgcctgacccgcaccgaccggggctggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggggccatcgtgtcctgctacggcaagaccaagtgcaccgccagcaacaagtgccgggggatcatcaagaccttctccaacggctgcgactacgtgagcaacaagggcgtcgacacggtgagcgtggggaacaccctctactacgtcaacaagcaggagggcaagtccctgtacgtgaagggggagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccggcaagtccaccaccaacatcatgatcaccacgatcatcatcgtgatcatcgtcatcctcctgagcctgatcgccgtggggctcctgctgtactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6026 - RNA, 2001 nt, synthetic construct
  misc_feature 1..2001: note = mRNA product Design h-5 comprising derived and/or modified sequence from HRSV(A2)__F-del_DSCav1_mut5 (opt2)
  source 1..2001: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6027 - RNA, 2001 nt, synthetic construct
  misc_feature 1..2001: note = mRNA product Design h-5 comprising derived and/or modified sequence from HRSV(A2)__F-del_DSCav1_mut5 (opt3)
  source 1..2001: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcggttgcggggtgtccgtattaacttttaaggttctggaccttaagaactacattgataaacaattgctgcctatcctaaataagcagtcatgtagtattagcaacatcgagaccgtgatagagttccagcagaaaaataacaggctcctggaaattacacgggagttttctgtcaatgcgggagtgactaccccagtgtccacatatatgcttaccaactcagaactgttgagcctcatcaatgacatgccgattacgaacgatcaaaagaaactgatgagtaacaatgtccagatcgttcgccagcagtcttactccatcatgtgcattataaaggaggaagtgttagcatatgtagtgcaactgcccctctacggcgtcatcgacactccttgttggaaacttcatacaagcccactgtgcaccactaacacaaaggagggctcgaatatttgtttgacccgaacggatcgtgggtggtactgcgacaacgccggatctgtgtccttctttccccaggctgaaacctgtaaggttcagtcaaatagagtgttctgcgatacaatgaacagtagaactctgcctagcgaggtcaatctctgcaacgtggacatctttaatccaaaatatgattgtaagataatgacctccaaaacagacgtatctagctcagttattaccagtctgggtgccatcgtgtcctgctacggcaagactaaatgtacagcaagcaacaagtgcagggggatcattaagaccttctctaatggatgtgattatgtctcaaacaaaggcgtggacactgtcagtgtgggtaatacgctttactatgttaacaagcaagaggggaaaagcctgtacgtgaagggagaacccatcattaatttttatgaccctttggtattcccatccgatgagtttgacgcttctatatcgcaggtcaacgagaaaatcaaccagagcctcgccttcattcggaagtccgatgaactgttacacaatgtgaacgcgggcaagtcaacaaccaatatcatgatcactaccattataatcgttattatcgtgattctgctaagtctcatcgccgtcggcctgcttttgtactgcaaagcacgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6028 - RNA, 2001 nt, synthetic construct
  misc_feature 1..2001: note = mRNA product Design h-5 comprising derived and/or modified sequence from HRSV(A2)__F-del_DSCav1_mut5 (opt4)
  source 1..2001: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6029 - RNA, 2001 nt, synthetic construct
  misc_feature 1..2001: note = mRNA product Design h-5 comprising derived and/or modified sequence from HRSV(A2)__F-del_DSCav1_mut5 (opt5)
  source 1..2001: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcggatgcggcgtttctgtgctgacatttaaggtccttgacctgaagaactacattgataaacaactcctgcctatcctgaataagcagtcctgtagcatttctaacatcgagaccgtgattgagttccagcagaaaaataaccggctcctggaaatcacgcgcgagttttccgtgaatgccggcgtcacaaccccggttagcacatatatgcttaccaactccgaactgctctctctgatcaatgacatgcccattaccaacgatcaaaagaaacttatgagcaacaatgtgcagatcgtgagacagcagtcctacagcattatgtgcatcattaaggaggaagtcctggcttatgtggttcaactccctctgtacggggtgatcgacacaccctgttggaaactgcatacgtctcctctctgcaccacaaacaccaaggagggatccaatatctgtctgacacggaccgatcgcggctggtactgcgacaacgccgggagcgtctctttctttccccaggcggaaacgtgtaaggtgcagagcaatagagttttctgcgatacaatgaactccagaaccctgccttctgaggtgaatctctgcaacgtcgacatttttaatccgaaatatgattgtaagatcatgaccagcaaaacagacgtgtccagctctgtcattacctccctgggagccatcgtgagctgctacggcaagacaaaatgtacggcttctaacaagtgccgggggattatcaagaccttctccaatggatgtgattatgttagcaacaaaggcgtggacacagtctccgtgggcaataccctttactatgttaacaagcaagaggggaaatctctgtacgtgaagggagaacccatcattaatttttatgaccctctcgtcttccccagcgatgagtttgacgcctccatctctcaggtgaacgagaaaattaaccagagcctggctttcatccgcaagtccgatgaactgctccacaatgtgaacgccggcaagagcacaaccaatattatgatcacgaccattatcatcgttattatcgtcattctgctttctctgatcgccgtggggctcctgctgtactgcaaagctagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6030 - RNA, 2001 nt, synthetic construct
  misc_feature 1..2001: note = mRNA product Design h-5 comprising derived and/or modified sequence from HRSV(A2)__F-del_DSCav1_mut5 (opt6)
  source 1..2001: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaacttttaatactgaaagcaaatgccatcacaaccatactaactgccgtcacattctgctttgcatcaggacaaaacataacagaagaattttaccaatccacatgctcagcagtatcaaaaggatatctatcggcacttagaactggatggtacacaagtgttataactatagaactctcaaacataaaagaaaacaaatgcaatggaacagacgcaaaagtaaaactaataaaacaagaactcgataaatataaaaatgcagtaaccgaactacaactattaatgcaaagcacacccgcaacaggcagcggatcagcaatagcaagcggagtcgcagtatgtaaagtactacatctagaaggagaagtcaacaaaatcaaatctgcacttctatccacaaacaaagctgtagtatccctatccggatgcggagtctcagtattaacttttaaagtactagaccttaaaaactacatagataaacaactattaccaatactaaataaacaatcatgcagcatatccaatatagagacagtaattgaatttcaacaaaaaaacaacagattactagaaattactcgtgaattttccgtaaatgccggagtcacaacaccagtatcaacctatatgctaacaaacagcgaactacttagcttaataaatgacatgccaataacaaatgaccaaaaaaaacttatgtcaaataacgtacaaatcgtcagacaacaatcctactctataatgtgtataattaaagaagaagtcctagcatacgtagttcaattaccactctatggagtaatagatacaccatgctggaaactacacacgtcaccactatgtacaacaaacacaaaagaaggatccaatatatgcctaacaagaaccgacagaggctggtattgtgacaacgcaggatccgtttcattcttcccacaagcagaaacctgtaaagtacaatctaatagagtattttgcgacacaatgaacagtagaacactaccaagcgaggttaatctatgtaacgtagacatattcaatccaaaatatgattgcaaaataatgacatcaaaaacagatgtatcgtcgagtgtaataacaagtctgggagctatagtaagctgctacggcaagacgaaatgtaccgcttcaaataaatgcagaggaatcattaaaacattctcgaacggatgcgactacgtaagtaataaaggtgtcgacaccgtatcagtagggaatacattatactacgtcaacaaacaagaaggaaaatctctatatgtaaaaggagaaccaataataaatttctatgaccctctagtattcccatcagatgaatttgacgcttccatatcacaagtaaacgaaaaaatcaatcaatctttagcattcatacgaaaaagtgatgaactcctacacaacgtcaacgcaggaaaaagcacaacaaatataatgatcacaacaatcatcatagtaataatagtaatactactatcattaatagcagtaggattattgctttactgcaaagcacgatagggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6031 - RNA, 2001 nt, synthetic construct
  misc_feature 1..2001: note = mRNA product Design h-5 comprising derived and/or modified sequence from HRSV(A2)__F-del_DSCav1_mut5 (opt11)
  source 1..2001: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcctcatcctcaaagccaacgccataaccacaatactcaccgccgtaaccttctgctttgcgtcgggacaaaacatcaccgaagagttctaccaatccacttgctccgcagtaagcaaaggatacctctccgccctgcgaaccggttggtacacatcagtcatcacaatcgaactctcaaacataaaagaaaacaaatgcaacggcaccgacgcaaaggtcaaattaatcaagcaagaactagacaaatacaaaaacgccgtcacagaactccagctgctaatgcagagcacacccgcaactggcagcggatccgccatcgcatcaggagtcgccgtgtgcaaagtcctacacctcgaaggagaagtgaacaaaatcaaatcagccctactctccaccaacaaggccgtcgtctccctctccggctgcggtgtctccgtcctaaccttcaaagtgctagacctcaagaactacatcgacaaacaactcctaccaatactcaacaagcaatcttgctccatctccaacatcgaaaccgtaatcgagttccaacagaagaacaaccgcctcctcgaaatcacccgcgagttctctgtcaacgcaggggtcaccactcccgtctccacatacatgctcacaaactccgaactcctcagcctcatcaacgacatgcccataaccaacgaccagaaaaagctaatgagcaataacgtccaaatcgttagacaacaaagttattccatcatgtgcatcatcaaagaagaagtcctcgcctacgtcgtacaactccccctctatggcgtcatcgacaccccctgctggaaactgcacacatcacccctctgcaccacaaacaccaaagaaggctcaaacatctgcctaactcgcaccgaccgcggctggtactgcgacaacgccggcagcgtatcattctttccccaagccgaaacatgcaaagttcaatccaaccgcgtcttctgcgacacaatgaactccagaacgctccccagcgaagtcaacctctgtaacgtagacatcttcaaccctaagtacgactgcaaaatcatgacctccaaaactgatgtatcctcctccgtcatcacatccctgggcgccatcgtcagctgctacggcaaaacaaaatgcactgcctcaaacaaatgccgaggtatcataaagaccttctcaaacggatgcgattacgtcagcaacaaaggcgtcgacaccgtcagtgtcggcaacaccctctactacgtcaacaaacaagaaggaaaatccctctacgtcaaaggcgaacccatcatcaacttctacgaccccctcgtcttccccagcgacgagttcgacgcctccatctcacaagtcaacgaaaagataaaccaatctctagccttcatccgcaaatccgatgaactcctgcataacgtcaacgccggcaaatccaccacaaacatcatgatcactaccataatcatcgtcataatcgtaatcctcctatctcttatcgcagtcggcctactactctactgcaaagcccgctaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6032 - RNA, 1934 nt, synthetic construct
  misc_feature 1..1934: note = mRNA product Design i-1 comprising derived and/or modified sequence from HRSV(A2)__F-del_DSCav1_mut5 (opt1)
  source 1..1934: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6033 - RNA, 1934 nt, synthetic construct
  misc_feature 1..1934: note = mRNA product Design i-1 comprising derived and/or modified sequence from HRSV(A2)__F-del_DSCav1_mut5 (opt1)
  source 1..1934: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcgggtgcggcgtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggggtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggcgtgatcgacacgccgtgctggaagctgcacaccagccccctctgcaccaccaacacgaaggaggggtccaacatctgcctgacccgcaccgaccggggctggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggggccatcgtgtcctgctacggcaagaccaagtgcaccgccagcaacaagtgccgggggatcatcaagaccttctccaacggctgcgactacgtgagcaacaagggcgtcgacacggtgagcgtggggaacaccctctactacgtcaacaagcaggagggcaagtccctgtacgtgaagggggagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccggcaagtccaccaccaacatcatgatcaccacgatcatcatcgtgatcatcgtcatcctcctgagcctgatcgccgtggggctcctgctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6034 - RNA, 1934 nt, synthetic construct
  misc_feature 1..1934: note = mRNA product Design i-1 comprising derived and/or modified sequence from HRSV(A2)__F-del_DSCav1_mut5 (opt2)
  source 1..1934: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6035 - RNA, 1934 nt, synthetic construct
  misc_feature 1..1934: note = mRNA product Design i-1 comprising derived and/or modified sequence from HRSV(A2)__F-del_DSCav1_mut5 (opt3)
  source 1..1934: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcggttgcggggtgtccgtattaacttttaaggttctggaccttaagaactacattgataaacaattgctgcctatcctaaataagcagtcatgtagtattagcaacatcgagaccgtgatagagttccagcagaaaaataacaggctcctggaaattacacgggagttttctgtcaatgcgggagtgactaccccagtgtccacatatatgcttaccaactcagaactgttgagcctcatcaatgacatgccgattacgaacgatcaaaagaaactgatgagtaacaatgtccagatcgttcgccagcagtcttactccatcatgtgcattataaaggaggaagtgttagcatatgtagtgcaactgcccctctacggcgtcatcgacactccttgttggaaacttcatacaagcccactgtgcaccactaacacaaaggagggctcgaatatttgtttgacccgaacggatcgtgggtggtactgcgacaacgccggatctgtgtccttctttccccaggctgaaacctgtaaggttcagtcaaatagagtgttctgcgatacaatgaacagtagaactctgcctagcgaggtcaatctctgcaacgtggacatctttaatccaaaatatgattgtaagataatgacctccaaaacagacgtatctagctcagttattaccagtctgggtgccatcgtgtcctgctacggcaagactaaatgtacagcaagcaacaagtgcagggggatcattaagaccttctctaatggatgtgattatgtctcaaacaaaggcgtggacactgtcagtgtgggtaatacgctttactatgttaacaagcaagaggggaaaagcctgtacgtgaagggagaacccatcattaatttttatgaccctttggtattcccatccgatgagtttgacgcttctatatcgcaggtcaacgagaaaatcaaccagagcctcgccttcattcggaagtccgatgaactgttacacaatgtgaacgcgggcaagtcaacaaccaatatcatgatcactaccattataatcgttattatcgtgattctgctaagtctcatcgccgtcggcctgcttttgtactgcaaagcacgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6036 - RNA, 1934 nt, synthetic construct
  misc_feature 1..1934: note = mRNA product Design i-1 comprising derived and/or modified sequence from HRSV(A2)__F-del_DSCav1_mut5 (opt4)
  source 1..1934: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6037 - RNA, 1934 nt, synthetic construct
  misc_feature 1..1934: note = mRNA product Design i-1 comprising derived and/or modified sequence from HRSV(A2)__F-del_DSCav1_mut5 (opt5)
  source 1..1934: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcggatgcggcgtttctgtgctgacatttaaggtccttgacctgaagaactacattgataaacaactcctgcctatcctgaataagcagtcctgtagcatttctaacatcgagaccgtgattgagttccagcagaaaaataaccggctcctggaaatcacgcgcgagttttccgtgaatgccggcgtcacaaccccggttagcacatatatgcttaccaactccgaactgctctctctgatcaatgacatgcccattaccaacgatcaaaagaaacttatgagcaacaatgtgcagatcgtgagacagcagtcctacagcattatgtgcatcattaaggaggaagtcctggcttatgtggttcaactccctctgtacggggtgatcgacacaccctgttggaaactgcatacgtctcctctctgcaccacaaacaccaaggagggatccaatatctgtctgacacggaccgatcgcggctggtactgcgacaacgccgggagcgtctctttctttccccaggcggaaacgtgtaaggtgcagagcaatagagttttctgcgatacaatgaactccagaaccctgccttctgaggtgaatctctgcaacgtcgacatttttaatccgaaatatgattgtaagatcatgaccagcaaaacagacgtgtccagctctgtcattacctccctgggagccatcgtgagctgctacggcaagacaaaatgtacggcttctaacaagtgccgggggattatcaagaccttctccaatggatgtgattatgttagcaacaaaggcgtggacacagtctccgtgggcaataccctttactatgttaacaagcaagaggggaaatctctgtacgtgaagggagaacccatcattaatttttatgaccctctcgtcttccccagcgatgagtttgacgcctccatctctcaggtgaacgagaaaattaaccagagcctggctttcatccgcaagtccgatgaactgctccacaatgtgaacgccggcaagagcacaaccaatattatgatcacgaccattatcatcgttattatcgtcattctgctttctctgatcgccgtggggctcctgctgtactgcaaagctagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6038 - RNA, 1934 nt, synthetic construct
  misc_feature 1..1934: note = mRNA product Design i-1 comprising derived and/or modified sequence from HRSV(A2)__F-del_DSCav1_mut5 (opt6)
  source 1..1934: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaacttttaatactgaaagcaaatgccatcacaaccatactaactgccgtcacattctgctttgcatcaggacaaaacataacagaagaattttaccaatccacatgctcagcagtatcaaaaggatatctatcggcacttagaactggatggtacacaagtgttataactatagaactctcaaacataaaagaaaacaaatgcaatggaacagacgcaaaagtaaaactaataaaacaagaactcgataaatataaaaatgcagtaaccgaactacaactattaatgcaaagcacacccgcaacaggcagcggatcagcaatagcaagcggagtcgcagtatgtaaagtactacatctagaaggagaagtcaacaaaatcaaatctgcacttctatccacaaacaaagctgtagtatccctatccggatgcggagtctcagtattaacttttaaagtactagaccttaaaaactacatagataaacaactattaccaatactaaataaacaatcatgcagcatatccaatatagagacagtaattgaatttcaacaaaaaaacaacagattactagaaattactcgtgaattttccgtaaatgccggagtcacaacaccagtatcaacctatatgctaacaaacagcgaactacttagcttaataaatgacatgccaataacaaatgaccaaaaaaaacttatgtcaaataacgtacaaatcgtcagacaacaatcctactctataatgtgtataattaaagaagaagtcctagcatacgtagttcaattaccactctatggagtaatagatacaccatgctggaaactacacacgtcaccactatgtacaacaaacacaaaagaaggatccaatatatgcctaacaagaaccgacagaggctggtattgtgacaacgcaggatccgtttcattcttcccacaagcagaaacctgtaaagtacaatctaatagagtattttgcgacacaatgaacagtagaacactaccaagcgaggttaatctatgtaacgtagacatattcaatccaaaatatgattgcaaaataatgacatcaaaaacagatgtatcgtcgagtgtaataacaagtctgggagctatagtaagctgctacggcaagacgaaatgtaccgcttcaaataaatgcagaggaatcattaaaacattctcgaacggatgcgactacgtaagtaataaaggtgtcgacaccgtatcagtagggaatacattatactacgtcaacaaacaagaaggaaaatctctatatgtaaaaggagaaccaataataaatttctatgaccctctagtattcccatcagatgaatttgacgcttccatatcacaagtaaacgaaaaaatcaatcaatctttagcattcatacgaaaaagtgatgaactcctacacaacgtcaacgcaggaaaaagcacaacaaatataatgatcacaacaatcatcatagtaataatagtaatactactatcattaatagcagtaggattattgctttactgcaaagcacgatagggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6039 - RNA, 1934 nt, synthetic construct
  misc_feature 1..1934: note = mRNA product Design i-1 comprising derived and/or modified sequence from HRSV(A2)__F-del_DSCav1_mut5 (opt11)
  source 1..1934: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcctcatcctcaaagccaacgccataaccacaatactcaccgccgtaaccttctgctttgcgtcgggacaaaacatcaccgaagagttctaccaatccacttgctccgcagtaagcaaaggatacctctccgccctgcgaaccggttggtacacatcagtcatcacaatcgaactctcaaacataaaagaaaacaaatgcaacggcaccgacgcaaaggtcaaattaatcaagcaagaactagacaaatacaaaaacgccgtcacagaactccagctgctaatgcagagcacacccgcaactggcagcggatccgccatcgcatcaggagtcgccgtgtgcaaagtcctacacctcgaaggagaagtgaacaaaatcaaatcagccctactctccaccaacaaggccgtcgtctccctctccggctgcggtgtctccgtcctaaccttcaaagtgctagacctcaagaactacatcgacaaacaactcctaccaatactcaacaagcaatcttgctccatctccaacatcgaaaccgtaatcgagttccaacagaagaacaaccgcctcctcgaaatcacccgcgagttctctgtcaacgcaggggtcaccactcccgtctccacatacatgctcacaaactccgaactcctcagcctcatcaacgacatgcccataaccaacgaccagaaaaagctaatgagcaataacgtccaaatcgttagacaacaaagttattccatcatgtgcatcatcaaagaagaagtcctcgcctacgtcgtacaactccccctctatggcgtcatcgacaccccctgctggaaactgcacacatcacccctctgcaccacaaacaccaaagaaggctcaaacatctgcctaactcgcaccgaccgcggctggtactgcgacaacgccggcagcgtatcattctttccccaagccgaaacatgcaaagttcaatccaaccgcgtcttctgcgacacaatgaactccagaacgctccccagcgaagtcaacctctgtaacgtagacatcttcaaccctaagtacgactgcaaaatcatgacctccaaaactgatgtatcctcctccgtcatcacatccctgggcgccatcgtcagctgctacggcaaaacaaaatgcactgcctcaaacaaatgccgaggtatcataaagaccttctcaaacggatgcgattacgtcagcaacaaaggcgtcgacaccgtcagtgtcggcaacaccctctactacgtcaacaaacaagaaggaaaatccctctacgtcaaaggcgaacccatcatcaacttctacgaccccctcgtcttccccagcgacgagttcgacgcctccatctcacaagtcaacgaaaagataaaccaatctctagccttcatccgcaaatccgatgaactcctgcataacgtcaacgccggcaaatccaccacaaacatcatgatcactaccataatcatcgtcataatcgtaatcctcctatctcttatcgcagtcggcctactactctactgcaaagcccgctaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6040 - RNA, 1934 nt, synthetic construct
  misc_feature 1..1934: note = mRNA product Design i-2 comprising derived and/or modified sequence from HRSV(A2)__F-del_DSCav1_mut5 (opt1)
  source 1..1934: mol_type = other RNA
gggagaggcgctgcctacggaggtggcagccatctccttctcggcatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6041 - RNA, 1934 nt, synthetic construct
  misc_feature 1..1934: note = mRNA product Design i-2 comprising derived and/or modified sequence from HRSV(A2)__F-del_DSCav1_mut5 (opt1)
  source 1..1934: mol_type = other RNA
gggagaggcgctgcctacggaggtggcagccatctccttctcggcatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcgggtgcggcgtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggggtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggcgtgatcgacacgccgtgctggaagctgcacaccagccccctctgcaccaccaacacgaaggaggggtccaacatctgcctgacccgcaccgaccggggctggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggggccatcgtgtcctgctacggcaagaccaagtgcaccgccagcaacaagtgccgggggatcatcaagaccttctccaacggctgcgactacgtgagcaacaagggcgtcgacacggtgagcgtggggaacaccctctactacgtcaacaagcaggagggcaagtccctgtacgtgaagggggagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccggcaagtccaccaccaacatcatgatcaccacgatcatcatcgtgatcatcgtcatcctcctgagcctgatcgccgtggggctcctgctgtactgcaaggcccggtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6042 - RNA, 1934 nt, synthetic construct
  misc_feature 1..1934: note = mRNA product Design i-2 comprising derived and/or modified sequence from HRSV(A2)__F-del_DSCav1_mut5 (opt2)
  source 1..1934: mol_type = other RNA
gggagaggcgctgcctacggaggtggcagccatctccttctcggcatcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6043 - RNA, 1934 nt, synthetic construct
  misc_feature 1..1934: note = mRNA product Design i-2 comprising derived and/or modified sequence from HRSV(A2)__F-del_DSCav1_mut5 (opt3)
  source 1..1934: mol_type = other RNA
gggagaggcgctgcctacggaggtggcagccatctccttctcggcatcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcggttgcggggtgtccgtattaacttttaaggttctggaccttaagaactacattgataaacaattgctgcctatcctaaataagcagtcatgtagtattagcaacatcgagaccgtgatagagttccagcagaaaaataacaggctcctggaaattacacgggagttttctgtcaatgcgggagtgactaccccagtgtccacatatatgcttaccaactcagaactgttgagcctcatcaatgacatgccgattacgaacgatcaaaagaaactgatgagtaacaatgtccagatcgttcgccagcagtcttactccatcatgtgcattataaaggaggaagtgttagcatatgtagtgcaactgcccctctacggcgtcatcgacactccttgttggaaacttcatacaagcccactgtgcaccactaacacaaaggagggctcgaatatttgtttgacccgaacggatcgtgggtggtactgcgacaacgccggatctgtgtccttctttccccaggctgaaacctgtaaggttcagtcaaatagagtgttctgcgatacaatgaacagtagaactctgcctagcgaggtcaatctctgcaacgtggacatctttaatccaaaatatgattgtaagataatgacctccaaaacagacgtatctagctcagttattaccagtctgggtgccatcgtgtcctgctacggcaagactaaatgtacagcaagcaacaagtgcagggggatcattaagaccttctctaatggatgtgattatgtctcaaacaaaggcgtggacactgtcagtgtgggtaatacgctttactatgttaacaagcaagaggggaaaagcctgtacgtgaagggagaacccatcattaatttttatgaccctttggtattcccatccgatgagtttgacgcttctatatcgcaggtcaacgagaaaatcaaccagagcctcgccttcattcggaagtccgatgaactgttacacaatgtgaacgcgggcaagtcaacaaccaatatcatgatcactaccattataatcgttattatcgtgattctgctaagtctcatcgccgtcggcctgcttttgtactgcaaagcacgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6044 - RNA, 1934 nt, synthetic construct
  misc_feature 1..1934: note = mRNA product Design i-2 comprising derived and/or modified sequence from HRSV(A2)__F-del_DSCav1_mut5 (opt4)
  source 1..1934: mol_type = other RNA
gggagaggcgctgcctacggaggtggcagccatctccttctcggcatcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6045 - RNA, 1934 nt, synthetic construct
  misc_feature 1..1934: note = mRNA product Design i-2 comprising derived and/or modified sequence from HRSV(A2)__F-del_DSCav1_mut5 (opt5)
  source 1..1934: mol_type = other RNA
gggagaggcgctgcctacggaggtggcagccatctccttctcggcatcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcggatgcggcgtttctgtgctgacatttaaggtccttgacctgaagaactacattgataaacaactcctgcctatcctgaataagcagtcctgtagcatttctaacatcgagaccgtgattgagttccagcagaaaaataaccggctcctggaaatcacgcgcgagttttccgtgaatgccggcgtcacaaccccggttagcacatatatgcttaccaactccgaactgctctctctgatcaatgacatgcccattaccaacgatcaaaagaaacttatgagcaacaatgtgcagatcgtgagacagcagtcctacagcattatgtgcatcattaaggaggaagtcctggcttatgtggttcaactccctctgtacggggtgatcgacacaccctgttggaaactgcatacgtctcctctctgcaccacaaacaccaaggagggatccaatatctgtctgacacggaccgatcgcggctggtactgcgacaacgccgggagcgtctctttctttccccaggcggaaacgtgtaaggtgcagagcaatagagttttctgcgatacaatgaactccagaaccctgccttctgaggtgaatctctgcaacgtcgacatttttaatccgaaatatgattgtaagatcatgaccagcaaaacagacgtgtccagctctgtcattacctccctgggagccatcgtgagctgctacggcaagacaaaatgtacggcttctaacaagtgccgggggattatcaagaccttctccaatggatgtgattatgttagcaacaaaggcgtggacacagtctccgtgggcaataccctttactatgttaacaagcaagaggggaaatctctgtacgtgaagggagaacccatcattaatttttatgaccctctcgtcttccccagcgatgagtttgacgcctccatctctcaggtgaacgagaaaattaaccagagcctggctttcatccgcaagtccgatgaactgctccacaatgtgaacgccggcaagagcacaaccaatattatgatcacgaccattatcatcgttattatcgtcattctgctttctctgatcgccgtggggctcctgctgtactgcaaagctagatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6046 - RNA, 1934 nt, synthetic construct
  misc_feature 1..1934: note = mRNA product Design i-2 comprising derived and/or modified sequence from HRSV(A2)__F-del_DSCav1_mut5 (opt6)
  source 1..1934: mol_type = other RNA
gggagaggcgctgcctacggaggtggcagccatctccttctcggcatcaagcttaccatggaacttttaatactgaaagcaaatgccatcacaaccatactaactgccgtcacattctgctttgcatcaggacaaaacataacagaagaattttaccaatccacatgctcagcagtatcaaaaggatatctatcggcacttagaactggatggtacacaagtgttataactatagaactctcaaacataaaagaaaacaaatgcaatggaacagacgcaaaagtaaaactaataaaacaagaactcgataaatataaaaatgcagtaaccgaactacaactattaatgcaaagcacacccgcaacaggcagcggatcagcaatagcaagcggagtcgcagtatgtaaagtactacatctagaaggagaagtcaacaaaatcaaatctgcacttctatccacaaacaaagctgtagtatccctatccggatgcggagtctcagtattaacttttaaagtactagaccttaaaaactacatagataaacaactattaccaatactaaataaacaatcatgcagcatatccaatatagagacagtaattgaatttcaacaaaaaaacaacagattactagaaattactcgtgaattttccgtaaatgccggagtcacaacaccagtatcaacctatatgctaacaaacagcgaactacttagcttaataaatgacatgccaataacaaatgaccaaaaaaaacttatgtcaaataacgtacaaatcgtcagacaacaatcctactctataatgtgtataattaaagaagaagtcctagcatacgtagttcaattaccactctatggagtaatagatacaccatgctggaaactacacacgtcaccactatgtacaacaaacacaaaagaaggatccaatatatgcctaacaagaaccgacagaggctggtattgtgacaacgcaggatccgtttcattcttcccacaagcagaaacctgtaaagtacaatctaatagagtattttgcgacacaatgaacagtagaacactaccaagcgaggttaatctatgtaacgtagacatattcaatccaaaatatgattgcaaaataatgacatcaaaaacagatgtatcgtcgagtgtaataacaagtctgggagctatagtaagctgctacggcaagacgaaatgtaccgcttcaaataaatgcagaggaatcattaaaacattctcgaacggatgcgactacgtaagtaataaaggtgtcgacaccgtatcagtagggaatacattatactacgtcaacaaacaagaaggaaaatctctatatgtaaaaggagaaccaataataaatttctatgaccctctagtattcccatcagatgaatttgacgcttccatatcacaagtaaacgaaaaaatcaatcaatctttagcattcatacgaaaaagtgatgaactcctacacaacgtcaacgcaggaaaaagcacaacaaatataatgatcacaacaatcatcatagtaataatagtaatactactatcattaatagcagtaggattattgctttactgcaaagcacgatagggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6047 - RNA, 1934 nt, synthetic construct
  misc_feature 1..1934: note = mRNA product Design i-2 comprising derived and/or modified sequence from HRSV(A2)__F-del_DSCav1_mut5 (opt11)
  source 1..1934: mol_type = other RNA
gggagaggcgctgcctacggaggtggcagccatctccttctcggcatcaagcttaccatggaactcctcatcctcaaagccaacgccataaccacaatactcaccgccgtaaccttctgctttgcgtcgggacaaaacatcaccgaagagttctaccaatccacttgctccgcagtaagcaaaggatacctctccgccctgcgaaccggttggtacacatcagtcatcacaatcgaactctcaaacataaaagaaaacaaatgcaacggcaccgacgcaaaggtcaaattaatcaagcaagaactagacaaatacaaaaacgccgtcacagaactccagctgctaatgcagagcacacccgcaactggcagcggatccgccatcgcatcaggagtcgccgtgtgcaaagtcctacacctcgaaggagaagtgaacaaaatcaaatcagccctactctccaccaacaaggccgtcgtctccctctccggctgcggtgtctccgtcctaaccttcaaagtgctagacctcaagaactacatcgacaaacaactcctaccaatactcaacaagcaatcttgctccatctccaacatcgaaaccgtaatcgagttccaacagaagaacaaccgcctcctcgaaatcacccgcgagttctctgtcaacgcaggggtcaccactcccgtctccacatacatgctcacaaactccgaactcctcagcctcatcaacgacatgcccataaccaacgaccagaaaaagctaatgagcaataacgtccaaatcgttagacaacaaagttattccatcatgtgcatcatcaaagaagaagtcctcgcctacgtcgtacaactccccctctatggcgtcatcgacaccccctgctggaaactgcacacatcacccctctgcaccacaaacaccaaagaaggctcaaacatctgcctaactcgcaccgaccgcggctggtactgcgacaacgccggcagcgtatcattctttccccaagccgaaacatgcaaagttcaatccaaccgcgtcttctgcgacacaatgaactccagaacgctccccagcgaagtcaacctctgtaacgtagacatcttcaaccctaagtacgactgcaaaatcatgacctccaaaactgatgtatcctcctccgtcatcacatccctgggcgccatcgtcagctgctacggcaaaacaaaatgcactgcctcaaacaaatgccgaggtatcataaagaccttctcaaacggatgcgattacgtcagcaacaaaggcgtcgacaccgtcagtgtcggcaacaccctctactacgtcaacaaacaagaaggaaaatccctctacgtcaaaggcgaacccatcatcaacttctacgaccccctcgtcttccccagcgacgagttcgacgcctccatctcacaagtcaacgaaaagataaaccaatctctagccttcatccgcaaatccgatgaactcctgcataacgtcaacgccggcaaatccaccacaaacatcatgatcactaccataatcatcgtcataatcgtaatcctcctatctcttatcgcagtcggcctactactctactgcaaagcccgctaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6048 - RNA, 1930 nt, synthetic construct
  misc_feature 1..1930: note = mRNA product Design i-2 comprising derived and/or modified sequence from HRSV(A2)__F-del_DSCav1_mut5 (opt1)
  source 1..1930: mol_type = other RNA
ggggcgctgcctacggaggtggcagccatctccttctcggcatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6049 - RNA, 1930 nt, synthetic construct
  misc_feature 1..1930: note = mRNA product Design i-2 comprising derived and/or modified sequence from HRSV(A2)__F-del_DSCav1_mut5 (opt1)
  source 1..1930: mol_type = other RNA
ggggcgctgcctacggaggtggcagccatctccttctcggcatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcgggtgcggcgtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggggtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggcgtgatcgacacgccgtgctggaagctgcacaccagccccctctgcaccaccaacacgaaggaggggtccaacatctgcctgacccgcaccgaccggggctggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggggccatcgtgtcctgctacggcaagaccaagtgcaccgccagcaacaagtgccgggggatcatcaagaccttctccaacggctgcgactacgtgagcaacaagggcgtcgacacggtgagcgtggggaacaccctctactacgtcaacaagcaggagggcaagtccctgtacgtgaagggggagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccggcaagtccaccaccaacatcatgatcaccacgatcatcatcgtgatcatcgtcatcctcctgagcctgatcgccgtggggctcctgctgtactgcaaggcccggtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6050 - RNA, 1930 nt, synthetic construct
  misc_feature 1..1930: note = mRNA product Design i-2 comprising derived and/or modified sequence from HRSV(A2)__F-del_DSCav1_mut5 (opt2)
  source 1..1930: mol_type = other RNA
ggggcgctgcctacggaggtggcagccatctccttctcggcatcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6051 - RNA, 1930 nt, synthetic construct
  misc_feature 1..1930: note = mRNA product Design i-2 comprising derived and/or modified sequence from HRSV(A2)__F-del_DSCav1_mut5 (opt3)
  source 1..1930: mol_type = other RNA
ggggcgctgcctacggaggtggcagccatctccttctcggcatcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcggttgcggggtgtccgtattaacttttaaggttctggaccttaagaactacattgataaacaattgctgcctatcctaaataagcagtcatgtagtattagcaacatcgagaccgtgatagagttccagcagaaaaataacaggctcctggaaattacacgggagttttctgtcaatgcgggagtgactaccccagtgtccacatatatgcttaccaactcagaactgttgagcctcatcaatgacatgccgattacgaacgatcaaaagaaactgatgagtaacaatgtccagatcgttcgccagcagtcttactccatcatgtgcattataaaggaggaagtgttagcatatgtagtgcaactgcccctctacggcgtcatcgacactccttgttggaaacttcatacaagcccactgtgcaccactaacacaaaggagggctcgaatatttgtttgacccgaacggatcgtgggtggtactgcgacaacgccggatctgtgtccttctttccccaggctgaaacctgtaaggttcagtcaaatagagtgttctgcgatacaatgaacagtagaactctgcctagcgaggtcaatctctgcaacgtggacatctttaatccaaaatatgattgtaagataatgacctccaaaacagacgtatctagctcagttattaccagtctgggtgccatcgtgtcctgctacggcaagactaaatgtacagcaagcaacaagtgcagggggatcattaagaccttctctaatggatgtgattatgtctcaaacaaaggcgtggacactgtcagtgtgggtaatacgctttactatgttaacaagcaagaggggaaaagcctgtacgtgaagggagaacccatcattaatttttatgaccctttggtattcccatccgatgagtttgacgcttctatatcgcaggtcaacgagaaaatcaaccagagcctcgccttcattcggaagtccgatgaactgttacacaatgtgaacgcgggcaagtcaacaaccaatatcatgatcactaccattataatcgttattatcgtgattctgctaagtctcatcgccgtcggcctgcttttgtactgcaaagcacgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6052 - RNA, 1930 nt, synthetic construct
  misc_feature 1..1930: note = mRNA product Design i-2 comprising derived and/or modified sequence from HRSV(A2)__F-del_DSCav1_mut5 (opt4)
  source 1..1930: mol_type = other RNA
ggggcgctgcctacggaggtggcagccatctccttctcggcatcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6053 - RNA, 1930 nt, synthetic construct
  misc_feature 1..1930: note = mRNA product Design i-2 comprising derived and/or modified sequence from HRSV(A2)__F-del_DSCav1_mut5 (opt5)
  source 1..1930: mol_type = other RNA
ggggcgctgcctacggaggtggcagccatctccttctcggcatcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcggatgcggcgtttctgtgctgacatttaaggtccttgacctgaagaactacattgataaacaactcctgcctatcctgaataagcagtcctgtagcatttctaacatcgagaccgtgattgagttccagcagaaaaataaccggctcctggaaatcacgcgcgagttttccgtgaatgccggcgtcacaaccccggttagcacatatatgcttaccaactccgaactgctctctctgatcaatgacatgcccattaccaacgatcaaaagaaacttatgagcaacaatgtgcagatcgtgagacagcagtcctacagcattatgtgcatcattaaggaggaagtcctggcttatgtggttcaactccctctgtacggggtgatcgacacaccctgttggaaactgcatacgtctcctctctgcaccacaaacaccaaggagggatccaatatctgtctgacacggaccgatcgcggctggtactgcgacaacgccgggagcgtctctttctttccccaggcggaaacgtgtaaggtgcagagcaatagagttttctgcgatacaatgaactccagaaccctgccttctgaggtgaatctctgcaacgtcgacatttttaatccgaaatatgattgtaagatcatgaccagcaaaacagacgtgtccagctctgtcattacctccctgggagccatcgtgagctgctacggcaagacaaaatgtacggcttctaacaagtgccgggggattatcaagaccttctccaatggatgtgattatgttagcaacaaaggcgtggacacagtctccgtgggcaataccctttactatgttaacaagcaagaggggaaatctctgtacgtgaagggagaacccatcattaatttttatgaccctctcgtcttccccagcgatgagtttgacgcctccatctctcaggtgaacgagaaaattaaccagagcctggctttcatccgcaagtccgatgaactgctccacaatgtgaacgccggcaagagcacaaccaatattatgatcacgaccattatcatcgttattatcgtcattctgctttctctgatcgccgtggggctcctgctgtactgcaaagctagatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6054 - RNA, 1930 nt, synthetic construct
  misc_feature 1..1930: note = mRNA product Design i-2 comprising derived and/or modified sequence from HRSV(A2)__F-del_DSCav1_mut5 (opt6)
  source 1..1930: mol_type = other RNA
ggggcgctgcctacggaggtggcagccatctccttctcggcatcaagcttaccatggaacttttaatactgaaagcaaatgccatcacaaccatactaactgccgtcacattctgctttgcatcaggacaaaacataacagaagaattttaccaatccacatgctcagcagtatcaaaaggatatctatcggcacttagaactggatggtacacaagtgttataactatagaactctcaaacataaaagaaaacaaatgcaatggaacagacgcaaaagtaaaactaataaaacaagaactcgataaatataaaaatgcagtaaccgaactacaactattaatgcaaagcacacccgcaacaggcagcggatcagcaatagcaagcggagtcgcagtatgtaaagtactacatctagaaggagaagtcaacaaaatcaaatctgcacttctatccacaaacaaagctgtagtatccctatccggatgcggagtctcagtattaacttttaaagtactagaccttaaaaactacatagataaacaactattaccaatactaaataaacaatcatgcagcatatccaatatagagacagtaattgaatttcaacaaaaaaacaacagattactagaaattactcgtgaattttccgtaaatgccggagtcacaacaccagtatcaacctatatgctaacaaacagcgaactacttagcttaataaatgacatgccaataacaaatgaccaaaaaaaacttatgtcaaataacgtacaaatcgtcagacaacaatcctactctataatgtgtataattaaagaagaagtcctagcatacgtagttcaattaccactctatggagtaatagatacaccatgctggaaactacacacgtcaccactatgtacaacaaacacaaaagaaggatccaatatatgcctaacaagaaccgacagaggctggtattgtgacaacgcaggatccgtttcattcttcccacaagcagaaacctgtaaagtacaatctaatagagtattttgcgacacaatgaacagtagaacactaccaagcgaggttaatctatgtaacgtagacatattcaatccaaaatatgattgcaaaataatgacatcaaaaacagatgtatcgtcgagtgtaataacaagtctgggagctatagtaagctgctacggcaagacgaaatgtaccgcttcaaataaatgcagaggaatcattaaaacattctcgaacggatgcgactacgtaagtaataaaggtgtcgacaccgtatcagtagggaatacattatactacgtcaacaaacaagaaggaaaatctctatatgtaaaaggagaaccaataataaatttctatgaccctctagtattcccatcagatgaatttgacgcttccatatcacaagtaaacgaaaaaatcaatcaatctttagcattcatacgaaaaagtgatgaactcctacacaacgtcaacgcaggaaaaagcacaacaaatataatgatcacaacaatcatcatagtaataatagtaatactactatcattaatagcagtaggattattgctttactgcaaagcacgatagggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6055 - RNA, 1930 nt, synthetic construct
  misc_feature 1..1930: note = mRNA product Design i-2 comprising derived and/or modified sequence from HRSV(A2)__F-del_DSCav1_mut5 (opt11)
  source 1..1930: mol_type = other RNA
ggggcgctgcctacggaggtggcagccatctccttctcggcatcaagcttaccatggaactcctcatcctcaaagccaacgccataaccacaatactcaccgccgtaaccttctgctttgcgtcgggacaaaacatcaccgaagagttctaccaatccacttgctccgcagtaagcaaaggatacctctccgccctgcgaaccggttggtacacatcagtcatcacaatcgaactctcaaacataaaagaaaacaaatgcaacggcaccgacgcaaaggtcaaattaatcaagcaagaactagacaaatacaaaaacgccgtcacagaactccagctgctaatgcagagcacacccgcaactggcagcggatccgccatcgcatcaggagtcgccgtgtgcaaagtcctacacctcgaaggagaagtgaacaaaatcaaatcagccctactctccaccaacaaggccgtcgtctccctctccggctgcggtgtctccgtcctaaccttcaaagtgctagacctcaagaactacatcgacaaacaactcctaccaatactcaacaagcaatcttgctccatctccaacatcgaaaccgtaatcgagttccaacagaagaacaaccgcctcctcgaaatcacccgcgagttctctgtcaacgcaggggtcaccactcccgtctccacatacatgctcacaaactccgaactcctcagcctcatcaacgacatgcccataaccaacgaccagaaaaagctaatgagcaataacgtccaaatcgttagacaacaaagttattccatcatgtgcatcatcaaagaagaagtcctcgcctacgtcgtacaactccccctctatggcgtcatcgacaccccctgctggaaactgcacacatcacccctctgcaccacaaacaccaaagaaggctcaaacatctgcctaactcgcaccgaccgcggctggtactgcgacaacgccggcagcgtatcattctttccccaagccgaaacatgcaaagttcaatccaaccgcgtcttctgcgacacaatgaactccagaacgctccccagcgaagtcaacctctgtaacgtagacatcttcaaccctaagtacgactgcaaaatcatgacctccaaaactgatgtatcctcctccgtcatcacatccctgggcgccatcgtcagctgctacggcaaaacaaaatgcactgcctcaaacaaatgccgaggtatcataaagaccttctcaaacggatgcgattacgtcagcaacaaaggcgtcgacaccgtcagtgtcggcaacaccctctactacgtcaacaaacaagaaggaaaatccctctacgtcaaaggcgaacccatcatcaacttctacgaccccctcgtcttccccagcgacgagttcgacgcctccatctcacaagtcaacgaaaagataaaccaatctctagccttcatccgcaaatccgatgaactcctgcataacgtcaacgccggcaaatccaccacaaacatcatgatcactaccataatcatcgtcataatcgtaatcctcctatctcttatcgcagtcggcctactactctactgcaaagcccgctaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6056 - RNA, 1765 nt, synthetic construct
  misc_feature 1..1765: note = mRNA product Design i-3 comprising derived and/or modified sequence from HRSV(A2)__F-del_DSCav1_mut5 (opt1) R7457
  source 1..1765: mol_type = other RNA
gggagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccggctgcggcgtcagcgtgctgaccttcaaggtgctggacctcaagaactacatcgacaagcagctgctgcccatcctgaacaagcagagctgctccatcagcaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactcccggacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagtgccgggggatcatcaagaccttctccaacggctgcgactacgtgagcaacaagggcgtggacaccgtgtccgtcgggaacaccctgtactacgtgaacaagcaggagggcaagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6057 - RNA, 1765 nt, synthetic construct
  misc_feature 1..1765: note = mRNA product Design i-3 comprising derived and/or modified sequence from HRSV(A2)__F-del_DSCav1_mut5 (opt1)
  source 1..1765: mol_type = other RNA
gggagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcagcgccctgcgcaccggctggtacacctccgtgatcaccatcgagctgagcaacatcaaggagaacaagtgcaacgggaccgacgccaaggtgaagctcatcaagcaggagctggacaagtacaagaacgcggtcacggagctgcagctcctgatgcagtccacccccgccaccggcagcgggtccgccatcgccagcggcgtggcggtgtgcaaggtcctgcacctcgagggcgaggtgaacaagatcaagtccgccctgctgagcaccaacaaggccgtggtctccctcagcgggtgcggcgtgtccgtgctgacgttcaaggtcctggacctcaagaactacatcgacaagcagctgctgccgatcctcaacaagcagagctgctccatcagcaacatcgagaccgtgatcgagttccagcagaagaacaaccggctgctggagatcacccgcgagttctccgtgaacgccggggtcaccacgcccgtgagcacctacatgctcaccaacagcgagctgctgtccctcatcaacgacatgcccatcaccaacgaccagaagaagctgatgagcaacaacgtgcagatcgtccggcagcagtcctacagcatcatgtgcatcatcaaggaggaggtgctggcctacgtggtccagctccccctgtacggcgtgatcgacacgccgtgctggaagctgcacaccagccccctctgcaccaccaacacgaaggaggggtccaacatctgcctgacccgcaccgaccggggctggtactgcgacaacgcgggctccgtgagcttcttcccccaggccgagacctgcaaggtccagtccaaccgcgtgttctgcgacacgatgaacagccggaccctcccctccgaggtcaacctgtgcaacgtggacatcttcaacccgaagtacgactgcaagatcatgaccagcaagaccgacgtgtccagctccgtcatcacgagcctgggggccatcgtgtcctgctacggcaagaccaagtgcaccgccagcaacaagtgccgggggatcatcaagaccttctccaacggctgcgactacgtgagcaacaagggcgtcgacacggtgagcgtggggaacaccctctactacgtcaacaagcaggagggcaagtccctgtacgtgaagggggagcccatcatcaacttctacgaccccctggtgttccccagcgacgagttcgacgcctccatcagccaggtcaacgagaagatcaaccagtccctcgcgttcatccgcaagagcgacgagctgctgcacaacgtgaacgccggcaagtccaccaccaacatcatgatcaccacgatcatcatcgtgatcatcgtcatcctcctgagcctgatcgccgtggggctcctgctgtactgcaaggcccggtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6058 - RNA, 1765 nt, synthetic construct
  misc_feature 1..1765: note = mRNA product Design i-3 comprising derived and/or modified sequence from HRSV(A2)__F-del_DSCav1_mut5 (opt2)
  source 1..1765: mol_type = other RNA
gggagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctctccgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgagctccagctcctcatgcagtccacccccgccaccggctccggctccgccatcgcctccggcgtcgccgtctgcaaggtcctccacctcgagggcgaggtcaacaagatcaagtccgccctcctctccaccaacaaggccgtcgtctccctctccggctgcggcgtctccgtcctcaccttcaaggtcctcgacctcaagaactacatcgacaagcagctcctccccatcctcaacaagcagtcctgctccatctccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactcccgcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagtgccgcggcatcatcaagaccttctccaacggctgcgactacgtctccaacaagggcgtcgacaccgtctccgtcggcaacaccctctactacgtcaacaagcaggagggcaagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6059 - RNA, 1765 nt, synthetic construct
  misc_feature 1..1765: note = mRNA product Design i-3 comprising derived and/or modified sequence from HRSV(A2)__F-del_DSCav1_mut5 (opt3)
  source 1..1765: mol_type = other RNA
gggagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgagtgctttaagaactggatggtacaccagcgttattacaatcgaactgtccaacattaaggagaataaatgcaacggtaccgacgccaaggtgaaactaatcaagcaggaactcgataagtataaaaatgcagtaactgagctgcagcttctgatgcagtctacacccgccaccggctcggggtcagctatagcaagcggagtggccgtctgtaaggtgttgcacctcgagggcgaagttaacaaaatcaagagtgctctgctgtccacgaataaagccgtggtctctctcagcggttgcggggtgtccgtattaacttttaaggttctggaccttaagaactacattgataaacaattgctgcctatcctaaataagcagtcatgtagtattagcaacatcgagaccgtgatagagttccagcagaaaaataacaggctcctggaaattacacgggagttttctgtcaatgcgggagtgactaccccagtgtccacatatatgcttaccaactcagaactgttgagcctcatcaatgacatgccgattacgaacgatcaaaagaaactgatgagtaacaatgtccagatcgttcgccagcagtcttactccatcatgtgcattataaaggaggaagtgttagcatatgtagtgcaactgcccctctacggcgtcatcgacactccttgttggaaacttcatacaagcccactgtgcaccactaacacaaaggagggctcgaatatttgtttgacccgaacggatcgtgggtggtactgcgacaacgccggatctgtgtccttctttccccaggctgaaacctgtaaggttcagtcaaatagagtgttctgcgatacaatgaacagtagaactctgcctagcgaggtcaatctctgcaacgtggacatctttaatccaaaatatgattgtaagataatgacctccaaaacagacgtatctagctcagttattaccagtctgggtgccatcgtgtcctgctacggcaagactaaatgtacagcaagcaacaagtgcagggggatcattaagaccttctctaatggatgtgattatgtctcaaacaaaggcgtggacactgtcagtgtgggtaatacgctttactatgttaacaagcaagaggggaaaagcctgtacgtgaagggagaacccatcattaatttttatgaccctttggtattcccatccgatgagtttgacgcttctatatcgcaggtcaacgagaaaatcaaccagagcctcgccttcattcggaagtccgatgaactgttacacaatgtgaacgcgggcaagtcaacaaccaatatcatgatcactaccattataatcgttattatcgtgattctgctaagtctcatcgccgtcggcctgcttttgtactgcaaagcacgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6060 - RNA, 1765 nt, synthetic construct
  misc_feature 1..1765: note = mRNA product Design i-3 comprising derived and/or modified sequence from HRSV(A2)__F-del_DSCav1_mut5 (opt4)
  source 1..1765: mol_type = other RNA
gggagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgagcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgagctgcagctgctgatgcagagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcggctgcggcgtgagcgtgctgaccttcaaggtgctggacctgaagaactacatcgacaagcagctgctgcccatcctgaacaagcagagctgcagcatcagcaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcagaaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagtgcagaggcatcatcaagaccttcagcaacggctgcgactacgtgagcaacaagggcgtggacaccgtgagcgtgggcaacaccctgtactacgtgaacaagcaggagggcaagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6061 - RNA, 1765 nt, synthetic construct
  misc_feature 1..1765: note = mRNA product Design i-3 comprising derived and/or modified sequence from HRSV(A2)__F-del_DSCav1_mut5 (opt5)
  source 1..1765: mol_type = other RNA
gggagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgtccgccctcagaacaggatggtacacctctgttatcacaattgaactgagcaacatcaaggagaataaatgcaacggcaccgacgccaaggtgaaacttatcaagcaggaactggataagtataaaaatgctgtgacggagctccagctgctgatgcagtccacccccgccacagggtctggaagcgctattgcctccggcgtcgcggtgtgtaaggttctccacctggagggggaagtgaacaaaatcaagagcgcccttctgtctaccaataaagctgtcgtgtccctcagcggatgcggcgtttctgtgctgacatttaaggtccttgacctgaagaactacattgataaacaactcctgcctatcctgaataagcagtcctgtagcatttctaacatcgagaccgtgattgagttccagcagaaaaataaccggctcctggaaatcacgcgcgagttttccgtgaatgccggcgtcacaaccccggttagcacatatatgcttaccaactccgaactgctctctctgatcaatgacatgcccattaccaacgatcaaaagaaacttatgagcaacaatgtgcagatcgtgagacagcagtcctacagcattatgtgcatcattaaggaggaagtcctggcttatgtggttcaactccctctgtacggggtgatcgacacaccctgttggaaactgcatacgtctcctctctgcaccacaaacaccaaggagggatccaatatctgtctgacacggaccgatcgcggctggtactgcgacaacgccgggagcgtctctttctttccccaggcggaaacgtgtaaggtgcagagcaatagagttttctgcgatacaatgaactccagaaccctgccttctgaggtgaatctctgcaacgtcgacatttttaatccgaaatatgattgtaagatcatgaccagcaaaacagacgtgtccagctctgtcattacctccctgggagccatcgtgagctgctacggcaagacaaaatgtacggcttctaacaagtgccgggggattatcaagaccttctccaatggatgtgattatgttagcaacaaaggcgtggacacagtctccgtgggcaataccctttactatgttaacaagcaagaggggaaatctctgtacgtgaagggagaacccatcattaatttttatgaccctctcgtcttccccagcgatgagtttgacgcctccatctctcaggtgaacgagaaaattaaccagagcctggctttcatccgcaagtccgatgaactgctccacaatgtgaacgccggcaagagcacaaccaatattatgatcacgaccattatcatcgttattatcgtcattctgctttctctgatcgccgtggggctcctgctgtactgcaaagctagatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6062 - RNA, 1765 nt, synthetic construct
  misc_feature 1..1765: note = mRNA product Design i-3 comprising derived and/or modified sequence from HRSV(A2)__F-del_DSCav1_mut5 (opt6)
  source 1..1765: mol_type = other RNA
gggagaaagcttaccatggaacttttaatactgaaagcaaatgccatcacaaccatactaactgccgtcacattctgctttgcatcaggacaaaacataacagaagaattttaccaatccacatgctcagcagtatcaaaaggatatctatcggcacttagaactggatggtacacaagtgttataactatagaactctcaaacataaaagaaaacaaatgcaatggaacagacgcaaaagtaaaactaataaaacaagaactcgataaatataaaaatgcagtaaccgaactacaactattaatgcaaagcacacccgcaacaggcagcggatcagcaatagcaagcggagtcgcagtatgtaaagtactacatctagaaggagaagtcaacaaaatcaaatctgcacttctatccacaaacaaagctgtagtatccctatccggatgcggagtctcagtattaacttttaaagtactagaccttaaaaactacatagataaacaactattaccaatactaaataaacaatcatgcagcatatccaatatagagacagtaattgaatttcaacaaaaaaacaacagattactagaaattactcgtgaattttccgtaaatgccggagtcacaacaccagtatcaacctatatgctaacaaacagcgaactacttagcttaataaatgacatgccaataacaaatgaccaaaaaaaacttatgtcaaataacgtacaaatcgtcagacaacaatcctactctataatgtgtataattaaagaagaagtcctagcatacgtagttcaattaccactctatggagtaatagatacaccatgctggaaactacacacgtcaccactatgtacaacaaacacaaaagaaggatccaatatatgcctaacaagaaccgacagaggctggtattgtgacaacgcaggatccgtttcattcttcccacaagcagaaacctgtaaagtacaatctaatagagtattttgcgacacaatgaacagtagaacactaccaagcgaggttaatctatgtaacgtagacatattcaatccaaaatatgattgcaaaataatgacatcaaaaacagatgtatcgtcgagtgtaataacaagtctgggagctatagtaagctgctacggcaagacgaaatgtaccgcttcaaataaatgcagaggaatcattaaaacattctcgaacggatgcgactacgtaagtaataaaggtgtcgacaccgtatcagtagggaatacattatactacgtcaacaaacaagaaggaaaatctctatatgtaaaaggagaaccaataataaatttctatgaccctctagtattcccatcagatgaatttgacgcttccatatcacaagtaaacgaaaaaatcaatcaatctttagcattcatacgaaaaagtgatgaactcctacacaacgtcaacgcaggaaaaagcacaacaaatataatgatcacaacaatcatcatagtaataatagtaatactactatcattaatagcagtaggattattgctttactgcaaagcacgatagggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6063 - RNA, 1765 nt, synthetic construct
  misc_feature 1..1765: note = mRNA product Design i-3 comprising derived and/or modified sequence from HRSV(A2)__F-del_DSCav1_mut5 (opt11)
  source 1..1765: mol_type = other RNA
gggagaaagcttaccatggaactcctcatcctcaaagccaacgccataaccacaatactcaccgccgtaaccttctgctttgcgtcgggacaaaacatcaccgaagagttctaccaatccacttgctccgcagtaagcaaaggatacctctccgccctgcgaaccggttggtacacatcagtcatcacaatcgaactctcaaacataaaagaaaacaaatgcaacggcaccgacgcaaaggtcaaattaatcaagcaagaactagacaaatacaaaaacgccgtcacagaactccagctgctaatgcagagcacacccgcaactggcagcggatccgccatcgcatcaggagtcgccgtgtgcaaagtcctacacctcgaaggagaagtgaacaaaatcaaatcagccctactctccaccaacaaggccgtcgtctccctctccggctgcggtgtctccgtcctaaccttcaaagtgctagacctcaagaactacatcgacaaacaactcctaccaatactcaacaagcaatcttgctccatctccaacatcgaaaccgtaatcgagttccaacagaagaacaaccgcctcctcgaaatcacccgcgagttctctgtcaacgcaggggtcaccactcccgtctccacatacatgctcacaaactccgaactcctcagcctcatcaacgacatgcccataaccaacgaccagaaaaagctaatgagcaataacgtccaaatcgttagacaacaaagttattccatcatgtgcatcatcaaagaagaagtcctcgcctacgtcgtacaactccccctctatggcgtcatcgacaccccctgctggaaactgcacacatcacccctctgcaccacaaacaccaaagaaggctcaaacatctgcctaactcgcaccgaccgcggctggtactgcgacaacgccggcagcgtatcattctttccccaagccgaaacatgcaaagttcaatccaaccgcgtcttctgcgacacaatgaactccagaacgctccccagcgaagtcaacctctgtaacgtagacatcttcaaccctaagtacgactgcaaaatcatgacctccaaaactgatgtatcctcctccgtcatcacatccctgggcgccatcgtcagctgctacggcaaaacaaaatgcactgcctcaaacaaatgccgaggtatcataaagaccttctcaaacggatgcgattacgtcagcaacaaaggcgtcgacaccgtcagtgtcggcaacaccctctactacgtcaacaaacaagaaggaaaatccctctacgtcaaaggcgaacccatcatcaacttctacgaccccctcgtcttccccagcgacgagttcgacgcctccatctcacaagtcaacgaaaagataaaccaatctctagccttcatccgcaaatccgatgaactcctgcataacgtcaacgccggcaaatccaccacaaacatcatgatcactaccataatcatcgtcataatcgtaatcctcctatctcttatcgcagtcggcctactactctactgcaaagcccgctaaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6064 - protein, 535 aa, synthetic construct
  REGION 1..535: note = derived and/or modified protein sequence (artificial) from HRSV(A2)__F_DSCav1_mut6
MELLILKANAITTILTAVTFCFASGQNITEEFYQSTCSAVSKGYLGALRTGWYTSVITIELSNIKENKCNGTDAKVKLIKQELDKYKNAVTDLQMLMCSTPATGSGSAIASGVAVCKVLHLEGEVNKIKSALLSTNKAVVSLSNGVSVLTFKVLDLKNYIDKQLLPILNKQSCSIPNPETVMEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVCSNRVFCDTMNSLTLPSEVNLCNVDIFNPKYDCKIMTSKTDVSSSVITSLGAIVSCYGKTKCTASNKNKGIIKTFSNGCDYVSNKGVDTVSVGNTLYYVNKQEGQSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 6065 - RNA, 1608 nt, synthetic construct
  misc_feature 1..1608: note = derived and/or modified CDS sequence (opt1) from HRSV(A2)__F_DSCav1_mut6
  source 1..1608: mol_type = other RNA
atggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaaccccgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactga

SEQ ID NO: 6066 - RNA, 1608 nt, synthetic construct
  misc_feature 1..1608: note = derived and/or modified CDS sequence (opt1) from HRSV(A2)__F_DSCav1_mut6
  source 1..1608: mol_type = other RNA
atggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctcatgtgcagcacccccgccaccgggtccggcagcgccatcgcctccggcgtggcggtgtgcaaggtcctgcacctggagggggaggtgaacaagatcaagagcgccctcctgtccaccaacaaggccgtggtcagcctgtccaacggcgtgagcgtgctcacgttcaaggtcctggacctgaagaactacatcgacaagcagctcctgccgatcctgaacaagcagtcctgcagcatccccaaccccgagaccgtgatggagttccagcagaagaacaaccggctcctggagatcacccgcgagttctccgtgaacgccggggtcaccacgcccgtgagcacctacatgctgaccaactccgagctcctgagcctgatcaacgacatgccgatcaccaacgaccagaagaagctcatgagcaacaacgtgcagatcgtccggcagcagtcctacagcatcatgtgcatcatcaaggaggaggtgctggcctacgtggtccagctgcccctctacggcgtgatcgacacgccctgctggaagctgcacaccagccccctgtgcaccaccaacacgaaggaggggagcaacatctgcctcacccgcaccgaccggggctggtactgcgacaacgcgggctccgtgagcttcttcccgcaggccgagacctgcaaggtctgctccaaccgcgtgttctgcgacacgatgaacagcctgaccctgccctccgaggtcaacctctgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaacaaggggatcatcaagaccttctccaacggctgcgactacgtgagcaacaagggcgtcgacacggtgtccgtggggaacaccctgtactacgtcaacaagcaggagggccagagcctctacgtgaagggggagcccatcatcaacttctacgacccgctggtgttccccagcgacgagttcgacgcctccatcagccaggtcaacgagaagatcaaccagtccctggcgttcatccggaagtccgacgagctcctgcacaacgtgaacgccggcaagtccaccaccaacatcatgatcaccacgatcatcatcgtgatcatcgtcatcctgctcagcctgatcgccgtggggctgctcctgtactgcaaggcccgctccacccccgtgaccctgagcaaggaccagctgtccggcatcaacaacatcgccttcagcaactga

SEQ ID NO: 6067 - RNA, 1608 nt, synthetic construct
  misc_feature 1..1608: note = derived and/or modified CDS sequence (opt2) from HRSV(A2)__F_DSCav1_mut6
  source 1..1608: mol_type = other RNA
atggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactga

SEQ ID NO: 6068 - RNA, 1608 nt, synthetic construct
  misc_feature 1..1608: note = derived and/or modified CDS sequence (opt3) from HRSV(A2)__F_DSCav1_mut6
  source 1..1608: mol_type = other RNA
atggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagatgcttatgtgttccacacccgccaccgggtctggatcggctatagcatcaggcgtggccgtctgcaaggtgctgcacttggagggtgaggttaacaaaatcaagagcgctctcctgagtacgaataaagccgtggtctccctgtctaacggggtgagcgtactcacttttaaggttttagatctgaagaattacattgacaaacagcttttgcctatcctgaacaagcaatcctgttcaattccaaatccggaaaccgtgatggagttccagcagaaaaacaataggctactcgaaatcacacgggagtttagtgtcaacgcgggagtgactacccccgtgagcacatatatgctgaccaattctgagcttctgtccttgataaacgatatgcctattacgaacgaccagaagaaactcatgtcaaataacgtccaaatcgttcgccagcagagctacagtattatgtgcatcatcaaggaagaggtgctggcatatgtagtgcagttaccactgtacggcgtcattgatactccctgttggaaactccatacatctcctctttgcaccactaatacaaaggaaggctccaacatatgtctgacccgaacggaccgtgggtggtactgcgataatgccggaagcgtgtcgttctttccacaagctgagacctgtaaggtttgctctaacagagtgttctgcgacacaatgaactccttgactctaccctcagaagtcaatctgtgtaatgtggatatctttaaccctaaatatgactgcaagattatgaccagtaaaacagatgtaagctcctctgttatcactagcctcggtgccatagtgtcatgttacggcaagaccaaatgcacagcaagtaataagaacaaggggattatcaaaaccttctccaatggatgtgactatgtcagcaacaagggcgtggacactgtctctgtgggtaatacgctgtactatgttaacaaacaggaggggcagtcactttacgtgaagggagagccaatcattaacttttatgatccgctggtattccccagtgacgaatttgatgctagcatctcccaagtcaatgagaaaattaaccagtctttggccttcataaggaagtcggacgaactcctgcacaatgtgaacgcgggcaagagcacaaccaatatcatgattactaccatcatcattgttataatcgtgattttactgtccctaatcgccgtcggcctcctgctttactgcaaagcacggtcaacacctgtgaccttgagtaaggatcagctgtctgggattaacaatatcgctttcagcaactga

SEQ ID NO: 6069 - RNA, 1608 nt, synthetic construct
  misc_feature 1..1608: note = derived and/or modified CDS sequence (opt4) from HRSV(A2)__F_DSCav1_mut6
  source 1..1608: mol_type = other RNA
atggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactga

SEQ ID NO: 6070 - RNA, 1608 nt, synthetic construct
  misc_feature 1..1608: note = derived and/or modified CDS sequence (opt5) from HRSV(A2)__F_DSCav1_mut6
  source 1..1608: mol_type = other RNA
atggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagatgctgatgtgtagcacccccgccacaggatccggctctgctattgccagcggggtcgcggtgtgcaaggttctgcacctcgagggagaggtgaacaaaatcaagtccgccctgcttagcaccaataaagctgtcgtgtctctgtccaacggcgttagcgtgctcacatttaaggtcctggatcttaagaattacattgacaaacagctgctccctatcctgaacaagcaatcttgttccattccgaatcccgaaaccgtgatggagttccagcagaaaaacaatcggctgctcgaaatcacgcgcgagtttagcgtgaacgccggcgtcacaacccctgtttctacatatatgctgaccaattccgagcttctgagcctcattaacgatatgcccatcaccaacgaccagaagaaactgatgtccaataacgtgcaaatcgtgagacagcagtcttacagcattatgtgcatcattaaggaagaggtccttgcttatgtggttcagctgcctctctacggggtgatcgatacaccctgttggaaactgcatacgtcccctctgtgcaccacaaataccaaggaaggaagcaacatttgtctcacacggaccgaccgcggctggtactgcgataatgccgggtctgtctccttctttccgcaagcggagacgtgtaaggtgtgcagcaacagagttttctgcgacacaatgaactctctgacccttcccagcgaagtgaatctgtgtaatgtcgatatctttaaccctaaatatgactgcaagatcatgacctccaaaacagatgtgtctagctccgtcattaccagcctcggagccatcgtgtcttgttacggcaagacaaaatgcacggcttccaataagaacaaggggattatcaaaaccttcagcaatggatgtgactatgtttctaacaagggcgtggacacagtctccgtgggcaataccctgtactatgttaacaaacaggaggggcagagcctttacgtgaagggagagcccattatcaacttttatgatcctctggtcttcccctccgacgaatttgatgcctctatcagccaagtgaatgagaaaattaaccagtccctcgctttcatccggaagtctgacgaactgctgcacaatgtgaacgccggcaagagcacaaccaatattatgatcacgaccattatcattgttatcatcgtcattctcctgtcccttatcgccgtggggctgctcctgtactgcaaagctcgcagcacaccggtgaccctgtctaaggatcagctttccggaattaacaatatcgcgttcagcaactga

SEQ ID NO: 6071 - RNA, 1608 nt, synthetic construct
  misc_feature 1..1608: note = derived and/or modified CDS sequence (opt6) from HRSV(A2)__F_DSCav1_mut6
  source 1..1608: mol_type = other RNA
atggaactattaatcttaaaagcaaatgctataaccacaatattaacagcagtaacattctgttttgcctccggacaaaacataacagaagaattttatcaatcaacatgctctgcagtatccaaaggttacttaggcgcactacgcactggatggtatacatcagtaataacaatagaactatcaaacataaaagaaaataaatgtaacggtactgacgcaaaagtgaaactaattaaacaagaactcgacaaatacaaaaatgctgtaacagacctacaaatgctaatgtgctcaacacccgcaaccggatcaggatcagccatagcctccggagtcgcagtatgcaaagtattacatcttgaaggagaagtaaataaaataaaatcagcattactatccacaaataaagccgtagtatcactatcaaacggtgtatccgtccttacattcaaagtattagatctaaaaaactacatagataaacaactactacccatcttaaacaaacaatcatgctcaattcccaacccagaaacagtcatggaatttcaacaaaaaaacaacagactcttagaaataacacgagaattttcagtaaacgcaggagtaaccacaccagtaagtacatacatgctcaccaactcagaattattatcacttattaacgacatgccaattacaaacgaccaaaaaaaattaatgtcaaacaatgtccaaattgttagacaacaatcatactctataatgtgtataataaaagaagaagtactagcttacgtagttcaattaccactatatggcgtaatagatacaccttgctggaaactacatacatctccattatgtacaactaacacaaaagaaggatctaacatatgcctaacacgcacagatcgaggatggtactgcgataatgcaggttccgtatcattctttccacaagcagaaacatgtaaagtatgctcaaacagagtattctgtgacactatgaactccttaaccctaccctcagaagtcaatctatgcaacgttgacatatttaacccaaaatacgactgtaaaatcatgacatctaaaacagacgtatcatcatcagttattacatccctaggagcaatagtatcttgctacggaaaaacaaaatgtacagcatccaacaaaaacaaaggaataatcaaaacattctcaaacggctgcgactacgtatcaaacaaaggtgtagacacagtatcagtaggaaatactttatattacgtaaataaacaagaaggacaatctctatacgttaaaggcgaacctattataaacttctacgacccactcgtattcccttcagacgaatttgacgcatctatatcccaagttaacgaaaaaatcaaccaatcattagcctttataagaaaatccgacgaattattacataacgtcaacgctggaaaatcaacaactaacataatgataaccacaataataatagtcatcatagttatattactaagtctaatagccgtaggcctcctactttattgcaaagcaagatcaacaccagtaacattatccaaagaccaactcagcggcataaacaatatagctttttcaaactag

SEQ ID NO: 6072 - RNA, 1608 nt, synthetic construct
  misc_feature 1..1608: note = derived and/or modified CDS sequence (opt11) from HRSV(A2)__F_DSCav1_mut6
  source 1..1608: mol_type = other RNA
atggaactcctcatcctcaaagccaacgcaatcacaaccatactaactgcagttactttctgcttcgcatccggccaaaacatcaccgaagagttctaccaatcaacctgctccgcagtctccaaaggatacctcggagcccttcgcaccggctggtacacctccgtcataaccatcgaactctcaaacataaaagaaaacaaatgcaacggcacagacgcgaaagtcaaacttatcaaacaagaactcgacaaatacaaaaacgccgtcaccgacctgcagatgctcatgtgctcaacccccgccacaggaagcggctctgctatcgcttccggcgtcgccgtctgcaaagtcctccacctcgaaggcgaagtaaacaaaatcaagtcagccctcctctccaccaacaaagccgtcgtctctctctcaaacggcgtatccgtcctcacattcaaagtcctcgacctcaaaaactacatcgacaaacaacttctccccatcctaaacaaacaatcatgctccatccccaaccccgaaacagtcatggaatttcaacaaaagaacaaccgcctcttagaaatcacccgagaattttccgtcaacgcgggagtcacaacccccgtttctacgtatatgctcaccaactccgaactcctttccctcataaacgacatgccaatcaccaacgaccaaaagaaactcatgtcaaacaacgtccaaatcgtccgacaacaatcctactctattatgtgcatcatcaaagaagaagttctcgcctacgtcgtccaactacccctctacggcgtgatcgacaccccctgctggaaactacacacctcacccctctgcaccaccaacaccaaggaaggctccaacatctgcctcacccgcaccgaccgcggctggtactgcgacaacgctggctccgtctcattcttcccgcaagccgaaacttgcaaagtatgctccaacagagtattctgcgacaccatgaactcactaaccctcccttccgaagtcaacctttgcaacgttgacatattcaacccaaagtacgattgcaaaattatgacatccaaaacagatgtctcctcctccgtcatcacatccctcggtgccattgtatcatgctacggaaaaaccaaatgcaccgcatccaacaaaaacaaaggaatcatcaaaaccttctcaaacggctgcgattacgtctcaaacaaaggagtcgacacagtctccgtcggaaacaccctatactacgtcaacaaacaagaaggccaatccctgtacgtcaaaggagaacccatcatcaacttctacgaccccctcgtcttcccgagcgacgagttcgacgcctccatctcacaagtcaatgaaaagatcaaccaatcccttgccttcatccggaaatcggacgaactcctacacaacgtgaacgctggaaaatcaaccaccaacatcatgatcacaaccatcattatcgtcatcatcgtcatactcctctccctaatcgccgtcggcctcctcctgtattgcaaagctcgctccacccccgtcaccctgtccaaagaccaactctccggaatcaacaacatcgccttctcaaactaa

SEQ ID NO: 6073 - RNA, 1884 nt, synthetic construct
  misc_feature 1..1884: note = mRNA product Design a-1 comprising derived and/or modified sequence from HRSV(A2)__F_DSCav1_mut6 (opt1)
  source 1..1884: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaaccccgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6074 - RNA, 1884 nt, synthetic construct
  misc_feature 1..1884: note = mRNA product Design a-1 comprising derived and/or modified sequence from HRSV(A2)__F_DSCav1_mut6 (opt1)
  source 1..1884: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctcatgtgcagcacccccgccaccgggtccggcagcgccatcgcctccggcgtggcggtgtgcaaggtcctgcacctggagggggaggtgaacaagatcaagagcgccctcctgtccaccaacaaggccgtggtcagcctgtccaacggcgtgagcgtgctcacgttcaaggtcctggacctgaagaactacatcgacaagcagctcctgccgatcctgaacaagcagtcctgcagcatccccaaccccgagaccgtgatggagttccagcagaagaacaaccggctcctggagatcacccgcgagttctccgtgaacgccggggtcaccacgcccgtgagcacctacatgctgaccaactccgagctcctgagcctgatcaacgacatgccgatcaccaacgaccagaagaagctcatgagcaacaacgtgcagatcgtccggcagcagtcctacagcatcatgtgcatcatcaaggaggaggtgctggcctacgtggtccagctgcccctctacggcgtgatcgacacgccctgctggaagctgcacaccagccccctgtgcaccaccaacacgaaggaggggagcaacatctgcctcacccgcaccgaccggggctggtactgcgacaacgcgggctccgtgagcttcttcccgcaggccgagacctgcaaggtctgctccaaccgcgtgttctgcgacacgatgaacagcctgaccctgccctccgaggtcaacctctgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaacaaggggatcatcaagaccttctccaacggctgcgactacgtgagcaacaagggcgtcgacacggtgtccgtggggaacaccctgtactacgtcaacaagcaggagggccagagcctctacgtgaagggggagcccatcatcaacttctacgacccgctggtgttccccagcgacgagttcgacgcctccatcagccaggtcaacgagaagatcaaccagtccctggcgttcatccggaagtccgacgagctcctgcacaacgtgaacgccggcaagtccaccaccaacatcatgatcaccacgatcatcatcgtgatcatcgtcatcctgctcagcctgatcgccgtggggctgctcctgtactgcaaggcccgctccacccccgtgaccctgagcaaggaccagctgtccggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6075 - RNA, 1884 nt, synthetic construct
  misc_feature 1..1884: note = mRNA product Design a-1 comprising derived and/or modified sequence from HRSV(A2)__F_DSCav1_mut6 (opt2)
  source 1..1884: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6076 - RNA, 1884 nt, synthetic construct
  misc_feature 1..1884: note = mRNA product Design a-1 comprising derived and/or modified sequence from HRSV(A2)__F_DSCav1_mut6 (opt3)
  source 1..1884: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagatgcttatgtgttccacacccgccaccgggtctggatcggctatagcatcaggcgtggccgtctgcaaggtgctgcacttggagggtgaggttaacaaaatcaagagcgctctcctgagtacgaataaagccgtggtctccctgtctaacggggtgagcgtactcacttttaaggttttagatctgaagaattacattgacaaacagcttttgcctatcctgaacaagcaatcctgttcaattccaaatccggaaaccgtgatggagttccagcagaaaaacaataggctactcgaaatcacacgggagtttagtgtcaacgcgggagtgactacccccgtgagcacatatatgctgaccaattctgagcttctgtccttgataaacgatatgcctattacgaacgaccagaagaaactcatgtcaaataacgtccaaatcgttcgccagcagagctacagtattatgtgcatcatcaaggaagaggtgctggcatatgtagtgcagttaccactgtacggcgtcattgatactccctgttggaaactccatacatctcctctttgcaccactaatacaaaggaaggctccaacatatgtctgacccgaacggaccgtgggtggtactgcgataatgccggaagcgtgtcgttctttccacaagctgagacctgtaaggtttgctctaacagagtgttctgcgacacaatgaactccttgactctaccctcagaagtcaatctgtgtaatgtggatatctttaaccctaaatatgactgcaagattatgaccagtaaaacagatgtaagctcctctgttatcactagcctcggtgccatagtgtcatgttacggcaagaccaaatgcacagcaagtaataagaacaaggggattatcaaaaccttctccaatggatgtgactatgtcagcaacaagggcgtggacactgtctctgtgggtaatacgctgtactatgttaacaaacaggaggggcagtcactttacgtgaagggagagccaatcattaacttttatgatccgctggtattccccagtgacgaatttgatgctagcatctcccaagtcaatgagaaaattaaccagtctttggccttcataaggaagtcggacgaactcctgcacaatgtgaacgcgggcaagagcacaaccaatatcatgattactaccatcatcattgttataatcgtgattttactgtccctaatcgccgtcggcctcctgctttactgcaaagcacggtcaacacctgtgaccttgagtaaggatcagctgtctgggattaacaatatcgctttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6077 - RNA, 1884 nt, synthetic construct
  misc_feature 1..1884: note = mRNA product Design a-1 comprising derived and/or modified sequence from HRSV(A2)__F_DSCav1_mut6 (opt4)
  source 1..1884: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6078 - RNA, 1884 nt, synthetic construct
  misc_feature 1..1884: note = mRNA product Design a-1 comprising derived and/or modified sequence from HRSV(A2)__F_DSCav1_mut6 (opt5)
  source 1..1884: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagatgctgatgtgtagcacccccgccacaggatccggctctgctattgccagcggggtcgcggtgtgcaaggttctgcacctcgagggagaggtgaacaaaatcaagtccgccctgcttagcaccaataaagctgtcgtgtctctgtccaacggcgttagcgtgctcacatttaaggtcctggatcttaagaattacattgacaaacagctgctccctatcctgaacaagcaatcttgttccattccgaatcccgaaaccgtgatggagttccagcagaaaaacaatcggctgctcgaaatcacgcgcgagtttagcgtgaacgccggcgtcacaacccctgtttctacatatatgctgaccaattccgagcttctgagcctcattaacgatatgcccatcaccaacgaccagaagaaactgatgtccaataacgtgcaaatcgtgagacagcagtcttacagcattatgtgcatcattaaggaagaggtccttgcttatgtggttcagctgcctctctacggggtgatcgatacaccctgttggaaactgcatacgtcccctctgtgcaccacaaataccaaggaaggaagcaacatttgtctcacacggaccgaccgcggctggtactgcgataatgccgggtctgtctccttctttccgcaagcggagacgtgtaaggtgtgcagcaacagagttttctgcgacacaatgaactctctgacccttcccagcgaagtgaatctgtgtaatgtcgatatctttaaccctaaatatgactgcaagatcatgacctccaaaacagatgtgtctagctccgtcattaccagcctcggagccatcgtgtcttgttacggcaagacaaaatgcacggcttccaataagaacaaggggattatcaaaaccttcagcaatggatgtgactatgtttctaacaagggcgtggacacagtctccgtgggcaataccctgtactatgttaacaaacaggaggggcagagcctttacgtgaagggagagcccattatcaacttttatgatcctctggtcttcccctccgacgaatttgatgcctctatcagccaagtgaatgagaaaattaaccagtccctcgctttcatccggaagtctgacgaactgctgcacaatgtgaacgccggcaagagcacaaccaatattatgatcacgaccattatcattgttatcatcgtcattctcctgtcccttatcgccgtggggctgctcctgtactgcaaagctcgcagcacaccggtgaccctgtctaaggatcagctttccggaattaacaatatcgcgttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6079 - RNA, 1884 nt, synthetic construct
  misc_feature 1..1884: note = mRNA product Design a-1 comprising derived and/or modified sequence from HRSV(A2)__F_DSCav1_mut6 (opt6)
  source 1..1884: mol_type = other RNA
gggagagtcccgcagtcggcgtccagcggctctgcttgttcgtgtgtgtgtcgttgcaggccttattcaagcttaccatggaactattaatcttaaaagcaaatgctataaccacaatattaacagcagtaacattctgttttgcctccggacaaaacataacagaagaattttatcaatcaacatgctctgcagtatccaaaggttacttaggcgcactacgcactggatggtatacatcagtaataacaatagaactatcaaacataaaagaaaataaatgtaacggtactgacgcaaaagtgaaactaattaaacaagaactcgacaaatacaaaaatgctgtaacagacctacaaatgctaatgtgctcaacacccgcaaccggatcaggatcagccatagcctccggagtcgcagtatgcaaagtattacatcttgaaggagaagtaaataaaataaaatcagcattactatccacaaataaagccgtagtatcactatcaaacggtgtatccgtccttacattcaaagtattagatctaaaaaactacatagataaacaactactacccatcttaaacaaacaatcatgctcaattcccaacccagaaacagtcatggaatttcaacaaaaaaacaacagactcttagaaataacacgagaattttcagtaaacgcaggagtaaccacaccagtaagtacatacatgctcaccaactcagaattattatcacttattaacgacatgccaattacaaacgaccaaaaaaaattaatgtcaaacaatgtccaaattgttagacaacaatcatactctataatgtgtataataaaagaagaagtactagcttacgtagttcaattaccactatatggcgtaatagatacaccttgctggaaactacatacatctccattatgtacaactaacacaaaagaaggatctaacatatgcctaacacgcacagatcgaggatggtactgcgataatgcaggttccgtatcattctttccacaagcagaaacatgtaaagtatgctcaaacagagtattctgtgacactatgaactccttaaccctaccctcagaagtcaatctatgcaacgttgacatatttaacccaaaatacgactgtaaaatcatgacatctaaaacagacgtatcatcatcagttattacatccctaggagcaatagtatcttgctacggaaaaacaaaatgtacagcatccaacaaaaacaaaggaataatcaaaacattctcaaacggctgcgactacgtatcaaacaaaggtgtagacacagtatcagtaggaaatactttatattacgtaaataaacaagaaggacaatctctatacgttaaaggcgaacctattataaacttctacgacccactcgtattcccttcagacgaatttgacgcatctatatcccaagttaacgaaaaaatcaaccaatcattagcctttataagaaaatccgacgaattattacataacgtcaacgctggaaaatcaacaactaacataatgataaccacaataataatagtcatcatagttatattactaagtctaatagccgtaggcctcctactttattgcaaagcaagatcaacaccagtaacattatccaaagaccaactcagcggcataaacaatatagctttttcaaactagggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6080 - RNA, 1884 nt, synthetic construct
  misc_feature 1..1884: note = mRNA product Design a-1 comprising derived and/or modified sequence from HRSV(A2)__F_DSCav1_mut6 (opt11)
  source 1..1884: mol_type = other RNA
gggagagtcccgcagtcggcgtccagcggctctgcttgttcgtgtgtgtgtcgttgcaggccttattcaagcttaccatggaactcctcatcctcaaagccaacgcaatcacaaccatactaactgcagttactttctgcttcgcatccggccaaaacatcaccgaagagttctaccaatcaacctgctccgcagtctccaaaggatacctcggagcccttcgcaccggctggtacacctccgtcataaccatcgaactctcaaacataaaagaaaacaaatgcaacggcacagacgcgaaagtcaaacttatcaaacaagaactcgacaaatacaaaaacgccgtcaccgacctgcagatgctcatgtgctcaacccccgccacaggaagcggctctgctatcgcttccggcgtcgccgtctgcaaagtcctccacctcgaaggcgaagtaaacaaaatcaagtcagccctcctctccaccaacaaagccgtcgtctctctctcaaacggcgtatccgtcctcacattcaaagtcctcgacctcaaaaactacatcgacaaacaacttctccccatcctaaacaaacaatcatgctccatccccaaccccgaaacagtcatggaatttcaacaaaagaacaaccgcctcttagaaatcacccgagaattttccgtcaacgcgggagtcacaacccccgtttctacgtatatgctcaccaactccgaactcctttccctcataaacgacatgccaatcaccaacgaccaaaagaaactcatgtcaaacaacgtccaaatcgtccgacaacaatcctactctattatgtgcatcatcaaagaagaagttctcgcctacgtcgtccaactacccctctacggcgtgatcgacaccccctgctggaaactacacacctcacccctctgcaccaccaacaccaaggaaggctccaacatctgcctcacccgcaccgaccgcggctggtactgcgacaacgctggctccgtctcattcttcccgcaagccgaaacttgcaaagtatgctccaacagagtattctgcgacaccatgaactcactaaccctcccttccgaagtcaacctttgcaacgttgacatattcaacccaaagtacgattgcaaaattatgacatccaaaacagatgtctcctcctccgtcatcacatccctcggtgccattgtatcatgctacggaaaaaccaaatgcaccgcatccaacaaaaacaaaggaatcatcaaaaccttctcaaacggctgcgattacgtctcaaacaaaggagtcgacacagtctccgtcggaaacaccctatactacgtcaacaaacaagaaggccaatccctgtacgtcaaaggagaacccatcatcaacttctacgaccccctcgtcttcccgagcgacgagttcgacgcctccatctcacaagtcaatgaaaagatcaaccaatcccttgccttcatccggaaatcggacgaactcctacacaacgtgaacgctggaaaatcaaccaccaacatcatgatcacaaccatcattatcgtcatcatcgtcatactcctctccctaatcgccgtcggcctcctcctgtattgcaaagctcgctccacccccgtcaccctgtccaaagaccaactctccggaatcaacaacatcgccttctcaaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6081 - RNA, 1903 nt, synthetic construct
  misc_feature 1..1903: note = mRNA product Design a-2 comprising derived and/or modified sequence from HRSV(A2)__F_DSCav1_mut6 (opt1)
  source 1..1903: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaaccccgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6082 - RNA, 1903 nt, synthetic construct
  misc_feature 1..1903: note = mRNA product Design a-2 comprising derived and/or modified sequence from HRSV(A2)__F_DSCav1_mut6 (opt1)
  source 1..1903: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctcatgtgcagcacccccgccaccgggtccggcagcgccatcgcctccggcgtggcggtgtgcaaggtcctgcacctggagggggaggtgaacaagatcaagagcgccctcctgtccaccaacaaggccgtggtcagcctgtccaacggcgtgagcgtgctcacgttcaaggtcctggacctgaagaactacatcgacaagcagctcctgccgatcctgaacaagcagtcctgcagcatccccaaccccgagaccgtgatggagttccagcagaagaacaaccggctcctggagatcacccgcgagttctccgtgaacgccggggtcaccacgcccgtgagcacctacatgctgaccaactccgagctcctgagcctgatcaacgacatgccgatcaccaacgaccagaagaagctcatgagcaacaacgtgcagatcgtccggcagcagtcctacagcatcatgtgcatcatcaaggaggaggtgctggcctacgtggtccagctgcccctctacggcgtgatcgacacgccctgctggaagctgcacaccagccccctgtgcaccaccaacacgaaggaggggagcaacatctgcctcacccgcaccgaccggggctggtactgcgacaacgcgggctccgtgagcttcttcccgcaggccgagacctgcaaggtctgctccaaccgcgtgttctgcgacacgatgaacagcctgaccctgccctccgaggtcaacctctgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaacaaggggatcatcaagaccttctccaacggctgcgactacgtgagcaacaagggcgtcgacacggtgtccgtggggaacaccctgtactacgtcaacaagcaggagggccagagcctctacgtgaagggggagcccatcatcaacttctacgacccgctggtgttccccagcgacgagttcgacgcctccatcagccaggtcaacgagaagatcaaccagtccctggcgttcatccggaagtccgacgagctcctgcacaacgtgaacgccggcaagtccaccaccaacatcatgatcaccacgatcatcatcgtgatcatcgtcatcctgctcagcctgatcgccgtggggctgctcctgtactgcaaggcccgctccacccccgtgaccctgagcaaggaccagctgtccggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6083 - RNA, 1903 nt, synthetic construct
  misc_feature 1..1903: note = mRNA product Design a-2 comprising derived and/or modified sequence from HRSV(A2)__F_DSCav1_mut6 (opt2)
  source 1..1903: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6084 - RNA, 1903 nt, synthetic construct
  misc_feature 1..1903: note = mRNA product Design a-2 comprising derived and/or modified sequence from HRSV(A2)__F_DSCav1_mut6 (opt3)
  source 1..1903: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagatgcttatgtgttccacacccgccaccgggtctggatcggctatagcatcaggcgtggccgtctgcaaggtgctgcacttggagggtgaggttaacaaaatcaagagcgctctcctgagtacgaataaagccgtggtctccctgtctaacggggtgagcgtactcacttttaaggttttagatctgaagaattacattgacaaacagcttttgcctatcctgaacaagcaatcctgttcaattccaaatccggaaaccgtgatggagttccagcagaaaaacaataggctactcgaaatcacacgggagtttagtgtcaacgcgggagtgactacccccgtgagcacatatatgctgaccaattctgagcttctgtccttgataaacgatatgcctattacgaacgaccagaagaaactcatgtcaaataacgtccaaatcgttcgccagcagagctacagtattatgtgcatcatcaaggaagaggtgctggcatatgtagtgcagttaccactgtacggcgtcattgatactccctgttggaaactccatacatctcctctttgcaccactaatacaaaggaaggctccaacatatgtctgacccgaacggaccgtgggtggtactgcgataatgccggaagcgtgtcgttctttccacaagctgagacctgtaaggtttgctctaacagagtgttctgcgacacaatgaactccttgactctaccctcagaagtcaatctgtgtaatgtggatatctttaaccctaaatatgactgcaagattatgaccagtaaaacagatgtaagctcctctgttatcactagcctcggtgccatagtgtcatgttacggcaagaccaaatgcacagcaagtaataagaacaaggggattatcaaaaccttctccaatggatgtgactatgtcagcaacaagggcgtggacactgtctctgtgggtaatacgctgtactatgttaacaaacaggaggggcagtcactttacgtgaagggagagccaatcattaacttttatgatccgctggtattccccagtgacgaatttgatgctagcatctcccaagtcaatgagaaaattaaccagtctttggccttcataaggaagtcggacgaactcctgcacaatgtgaacgcgggcaagagcacaaccaatatcatgattactaccatcatcattgttataatcgtgattttactgtccctaatcgccgtcggcctcctgctttactgcaaagcacggtcaacacctgtgaccttgagtaaggatcagctgtctgggattaacaatatcgctttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6085 - RNA, 1903 nt, synthetic construct
  misc_feature 1..1903: note = mRNA product Design a-2 comprising derived and/or modified sequence from HRSV(A2)__F_DSCav1_mut6 (opt4)
  source 1..1903: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6086 - RNA, 1903 nt, synthetic construct
  misc_feature 1..1903: note = mRNA product Design a-2 comprising derived and/or modified sequence from HRSV(A2)__F_DSCav1_mut6 (opt5)
  source 1..1903: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagatgctgatgtgtagcacccccgccacaggatccggctctgctattgccagcggggtcgcggtgtgcaaggttctgcacctcgagggagaggtgaacaaaatcaagtccgccctgcttagcaccaataaagctgtcgtgtctctgtccaacggcgttagcgtgctcacatttaaggtcctggatcttaagaattacattgacaaacagctgctccctatcctgaacaagcaatcttgttccattccgaatcccgaaaccgtgatggagttccagcagaaaaacaatcggctgctcgaaatcacgcgcgagtttagcgtgaacgccggcgtcacaacccctgtttctacatatatgctgaccaattccgagcttctgagcctcattaacgatatgcccatcaccaacgaccagaagaaactgatgtccaataacgtgcaaatcgtgagacagcagtcttacagcattatgtgcatcattaaggaagaggtccttgcttatgtggttcagctgcctctctacggggtgatcgatacaccctgttggaaactgcatacgtcccctctgtgcaccacaaataccaaggaaggaagcaacatttgtctcacacggaccgaccgcggctggtactgcgataatgccgggtctgtctccttctttccgcaagcggagacgtgtaaggtgtgcagcaacagagttttctgcgacacaatgaactctctgacccttcccagcgaagtgaatctgtgtaatgtcgatatctttaaccctaaatatgactgcaagatcatgacctccaaaacagatgtgtctagctccgtcattaccagcctcggagccatcgtgtcttgttacggcaagacaaaatgcacggcttccaataagaacaaggggattatcaaaaccttcagcaatggatgtgactatgtttctaacaagggcgtggacacagtctccgtgggcaataccctgtactatgttaacaaacaggaggggcagagcctttacgtgaagggagagcccattatcaacttttatgatcctctggtcttcccctccgacgaatttgatgcctctatcagccaagtgaatgagaaaattaaccagtccctcgctttcatccggaagtctgacgaactgctgcacaatgtgaacgccggcaagagcacaaccaatattatgatcacgaccattatcattgttatcatcgtcattctcctgtcccttatcgccgtggggctgctcctgtactgcaaagctcgcagcacaccggtgaccctgtctaaggatcagctttccggaattaacaatatcgcgttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6087 - RNA, 1903 nt, synthetic construct
  misc_feature 1..1903: note = mRNA product Design a-2 comprising derived and/or modified sequence from HRSV(A2)__F_DSCav1_mut6 (opt6)
  source 1..1903: mol_type = other RNA
gggagagtccgctcagccaggttgcagaagcggcttagcgtgtgtcctaatcttctctctgcgtgtaggtaggcctgtgccgcaaacaagcttaccatggaactattaatcttaaaagcaaatgctataaccacaatattaacagcagtaacattctgttttgcctccggacaaaacataacagaagaattttatcaatcaacatgctctgcagtatccaaaggttacttaggcgcactacgcactggatggtatacatcagtaataacaatagaactatcaaacataaaagaaaataaatgtaacggtactgacgcaaaagtgaaactaattaaacaagaactcgacaaatacaaaaatgctgtaacagacctacaaatgctaatgtgctcaacacccgcaaccggatcaggatcagccatagcctccggagtcgcagtatgcaaagtattacatcttgaaggagaagtaaataaaataaaatcagcattactatccacaaataaagccgtagtatcactatcaaacggtgtatccgtccttacattcaaagtattagatctaaaaaactacatagataaacaactactacccatcttaaacaaacaatcatgctcaattcccaacccagaaacagtcatggaatttcaacaaaaaaacaacagactcttagaaataacacgagaattttcagtaaacgcaggagtaaccacaccagtaagtacatacatgctcaccaactcagaattattatcacttattaacgacatgccaattacaaacgaccaaaaaaaattaatgtcaaacaatgtccaaattgttagacaacaatcatactctataatgtgtataataaaagaagaagtactagcttacgtagttcaattaccactatatggcgtaatagatacaccttgctggaaactacatacatctccattatgtacaactaacacaaaagaaggatctaacatatgcctaacacgcacagatcgaggatggtactgcgataatgcaggttccgtatcattctttccacaagcagaaacatgtaaagtatgctcaaacagagtattctgtgacactatgaactccttaaccctaccctcagaagtcaatctatgcaacgttgacatatttaacccaaaatacgactgtaaaatcatgacatctaaaacagacgtatcatcatcagttattacatccctaggagcaatagtatcttgctacggaaaaacaaaatgtacagcatccaacaaaaacaaaggaataatcaaaacattctcaaacggctgcgactacgtatcaaacaaaggtgtagacacagtatcagtaggaaatactttatattacgtaaataaacaagaaggacaatctctatacgttaaaggcgaacctattataaacttctacgacccactcgtattcccttcagacgaatttgacgcatctatatcccaagttaacgaaaaaatcaaccaatcattagcctttataagaaaatccgacgaattattacataacgtcaacgctggaaaatcaacaactaacataatgataaccacaataataatagtcatcatagttatattactaagtctaatagccgtaggcctcctactttattgcaaagcaagatcaacaccagtaacattatccaaagaccaactcagcggcataaacaatatagctttttcaaactagggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6088 - RNA, 1903 nt, synthetic construct
  misc_feature 1..1903: note = mRNA product Design a-2 comprising derived and/or modified sequence from HRSV(A2)__F_DSCav1_mut6 (opt11)
  source 1..1903: mol_type = other RNA
gggagagtccgctcagccaggttgcagaagcggcttagcgtgtgtcctaatcttctctctgcgtgtaggtaggcctgtgccgcaaacaagcttaccatggaactcctcatcctcaaagccaacgcaatcacaaccatactaactgcagttactttctgcttcgcatccggccaaaacatcaccgaagagttctaccaatcaacctgctccgcagtctccaaaggatacctcggagcccttcgcaccggctggtacacctccgtcataaccatcgaactctcaaacataaaagaaaacaaatgcaacggcacagacgcgaaagtcaaacttatcaaacaagaactcgacaaatacaaaaacgccgtcaccgacctgcagatgctcatgtgctcaacccccgccacaggaagcggctctgctatcgcttccggcgtcgccgtctgcaaagtcctccacctcgaaggcgaagtaaacaaaatcaagtcagccctcctctccaccaacaaagccgtcgtctctctctcaaacggcgtatccgtcctcacattcaaagtcctcgacctcaaaaactacatcgacaaacaacttctccccatcctaaacaaacaatcatgctccatccccaaccccgaaacagtcatggaatttcaacaaaagaacaaccgcctcttagaaatcacccgagaattttccgtcaacgcgggagtcacaacccccgtttctacgtatatgctcaccaactccgaactcctttccctcataaacgacatgccaatcaccaacgaccaaaagaaactcatgtcaaacaacgtccaaatcgtccgacaacaatcctactctattatgtgcatcatcaaagaagaagttctcgcctacgtcgtccaactacccctctacggcgtgatcgacaccccctgctggaaactacacacctcacccctctgcaccaccaacaccaaggaaggctccaacatctgcctcacccgcaccgaccgcggctggtactgcgacaacgctggctccgtctcattcttcccgcaagccgaaacttgcaaagtatgctccaacagagtattctgcgacaccatgaactcactaaccctcccttccgaagtcaacctttgcaacgttgacatattcaacccaaagtacgattgcaaaattatgacatccaaaacagatgtctcctcctccgtcatcacatccctcggtgccattgtatcatgctacggaaaaaccaaatgcaccgcatccaacaaaaacaaaggaatcatcaaaaccttctcaaacggctgcgattacgtctcaaacaaaggagtcgacacagtctccgtcggaaacaccctatactacgtcaacaaacaagaaggccaatccctgtacgtcaaaggagaacccatcatcaacttctacgaccccctcgtcttcccgagcgacgagttcgacgcctccatctcacaagtcaatgaaaagatcaaccaatcccttgccttcatccggaaatcggacgaactcctacacaacgtgaacgctggaaaatcaaccaccaacatcatgatcacaaccatcattatcgtcatcatcgtcatactcctctccctaatcgccgtcggcctcctcctgtattgcaaagctcgctccacccccgtcaccctgtccaaagaccaactctccggaatcaacaacatcgccttctcaaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6089 - RNA, 1981 nt, synthetic construct
  misc_feature 1..1981: note = mRNA product Design a-3 comprising derived and/or modified sequence from HRSV(A2)__F_DSCav1_mut6 (opt1)
  source 1..1981: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaaccccgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6090 - RNA, 1981 nt, synthetic construct
  misc_feature 1..1981: note = mRNA product Design a-3 comprising derived and/or modified sequence from HRSV(A2)__F_DSCav1_mut6 (opt1)
  source 1..1981: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctcatgtgcagcacccccgccaccgggtccggcagcgccatcgcctccggcgtggcggtgtgcaaggtcctgcacctggagggggaggtgaacaagatcaagagcgccctcctgtccaccaacaaggccgtggtcagcctgtccaacggcgtgagcgtgctcacgttcaaggtcctggacctgaagaactacatcgacaagcagctcctgccgatcctgaacaagcagtcctgcagcatccccaaccccgagaccgtgatggagttccagcagaagaacaaccggctcctggagatcacccgcgagttctccgtgaacgccggggtcaccacgcccgtgagcacctacatgctgaccaactccgagctcctgagcctgatcaacgacatgccgatcaccaacgaccagaagaagctcatgagcaacaacgtgcagatcgtccggcagcagtcctacagcatcatgtgcatcatcaaggaggaggtgctggcctacgtggtccagctgcccctctacggcgtgatcgacacgccctgctggaagctgcacaccagccccctgtgcaccaccaacacgaaggaggggagcaacatctgcctcacccgcaccgaccggggctggtactgcgacaacgcgggctccgtgagcttcttcccgcaggccgagacctgcaaggtctgctccaaccgcgtgttctgcgacacgatgaacagcctgaccctgccctccgaggtcaacctctgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaacaaggggatcatcaagaccttctccaacggctgcgactacgtgagcaacaagggcgtcgacacggtgtccgtggggaacaccctgtactacgtcaacaagcaggagggccagagcctctacgtgaagggggagcccatcatcaacttctacgacccgctggtgttccccagcgacgagttcgacgcctccatcagccaggtcaacgagaagatcaaccagtccctggcgttcatccggaagtccgacgagctcctgcacaacgtgaacgccggcaagtccaccaccaacatcatgatcaccacgatcatcatcgtgatcatcgtcatcctgctcagcctgatcgccgtggggctgctcctgtactgcaaggcccgctccacccccgtgaccctgagcaaggaccagctgtccggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6091 - RNA, 1981 nt, synthetic construct
  misc_feature 1..1981: note = mRNA product Design a-3 comprising derived and/or modified sequence from HRSV(A2)__F_DSCav1_mut6 (opt2)
  source 1..1981: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6092 - RNA, 1981 nt, synthetic construct
  misc_feature 1..1981: note = mRNA product Design a-3 comprising derived and/or modified sequence from HRSV(A2)__F_DSCav1_mut6 (opt3)
  source 1..1981: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagatgcttatgtgttccacacccgccaccgggtctggatcggctatagcatcaggcgtggccgtctgcaaggtgctgcacttggagggtgaggttaacaaaatcaagagcgctctcctgagtacgaataaagccgtggtctccctgtctaacggggtgagcgtactcacttttaaggttttagatctgaagaattacattgacaaacagcttttgcctatcctgaacaagcaatcctgttcaattccaaatccggaaaccgtgatggagttccagcagaaaaacaataggctactcgaaatcacacgggagtttagtgtcaacgcgggagtgactacccccgtgagcacatatatgctgaccaattctgagcttctgtccttgataaacgatatgcctattacgaacgaccagaagaaactcatgtcaaataacgtccaaatcgttcgccagcagagctacagtattatgtgcatcatcaaggaagaggtgctggcatatgtagtgcagttaccactgtacggcgtcattgatactccctgttggaaactccatacatctcctctttgcaccactaatacaaaggaaggctccaacatatgtctgacccgaacggaccgtgggtggtactgcgataatgccggaagcgtgtcgttctttccacaagctgagacctgtaaggtttgctctaacagagtgttctgcgacacaatgaactccttgactctaccctcagaagtcaatctgtgtaatgtggatatctttaaccctaaatatgactgcaagattatgaccagtaaaacagatgtaagctcctctgttatcactagcctcggtgccatagtgtcatgttacggcaagaccaaatgcacagcaagtaataagaacaaggggattatcaaaaccttctccaatggatgtgactatgtcagcaacaagggcgtggacactgtctctgtgggtaatacgctgtactatgttaacaaacaggaggggcagtcactttacgtgaagggagagccaatcattaacttttatgatccgctggtattccccagtgacgaatttgatgctagcatctcccaagtcaatgagaaaattaaccagtctttggccttcataaggaagtcggacgaactcctgcacaatgtgaacgcgggcaagagcacaaccaatatcatgattactaccatcatcattgttataatcgtgattttactgtccctaatcgccgtcggcctcctgctttactgcaaagcacggtcaacacctgtgaccttgagtaaggatcagctgtctgggattaacaatatcgctttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6093 - RNA, 1981 nt, synthetic construct
  misc_feature 1..1981: note = mRNA product Design a-3 comprising derived and/or modified sequence from HRSV(A2)__F_DSCav1_mut6 (opt4)
  source 1..1981: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6094 - RNA, 1981 nt, synthetic construct
  misc_feature 1..1981: note = mRNA product Design a-3 comprising derived and/or modified sequence from HRSV(A2)__F_DSCav1_mut6 (opt5)
  source 1..1981: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagatgctgatgtgtagcacccccgccacaggatccggctctgctattgccagcggggtcgcggtgtgcaaggttctgcacctcgagggagaggtgaacaaaatcaagtccgccctgcttagcaccaataaagctgtcgtgtctctgtccaacggcgttagcgtgctcacatttaaggtcctggatcttaagaattacattgacaaacagctgctccctatcctgaacaagcaatcttgttccattccgaatcccgaaaccgtgatggagttccagcagaaaaacaatcggctgctcgaaatcacgcgcgagtttagcgtgaacgccggcgtcacaacccctgtttctacatatatgctgaccaattccgagcttctgagcctcattaacgatatgcccatcaccaacgaccagaagaaactgatgtccaataacgtgcaaatcgtgagacagcagtcttacagcattatgtgcatcattaaggaagaggtccttgcttatgtggttcagctgcctctctacggggtgatcgatacaccctgttggaaactgcatacgtcccctctgtgcaccacaaataccaaggaaggaagcaacatttgtctcacacggaccgaccgcggctggtactgcgataatgccgggtctgtctccttctttccgcaagcggagacgtgtaaggtgtgcagcaacagagttttctgcgacacaatgaactctctgacccttcccagcgaagtgaatctgtgtaatgtcgatatctttaaccctaaatatgactgcaagatcatgacctccaaaacagatgtgtctagctccgtcattaccagcctcggagccatcgtgtcttgttacggcaagacaaaatgcacggcttccaataagaacaaggggattatcaaaaccttcagcaatggatgtgactatgtttctaacaagggcgtggacacagtctccgtgggcaataccctgtactatgttaacaaacaggaggggcagagcctttacgtgaagggagagcccattatcaacttttatgatcctctggtcttcccctccgacgaatttgatgcctctatcagccaagtgaatgagaaaattaaccagtccctcgctttcatccggaagtctgacgaactgctgcacaatgtgaacgccggcaagagcacaaccaatattatgatcacgaccattatcattgttatcatcgtcattctcctgtcccttatcgccgtggggctgctcctgtactgcaaagctcgcagcacaccggtgaccctgtctaaggatcagctttccggaattaacaatatcgcgttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6095 - RNA, 1981 nt, synthetic construct
  misc_feature 1..1981: note = mRNA product Design a-3 comprising derived and/or modified sequence from HRSV(A2)__F_DSCav1_mut6 (opt6)
  source 1..1981: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactattaatcttaaaagcaaatgctataaccacaatattaacagcagtaacattctgttttgcctccggacaaaacataacagaagaattttatcaatcaacatgctctgcagtatccaaaggttacttaggcgcactacgcactggatggtatacatcagtaataacaatagaactatcaaacataaaagaaaataaatgtaacggtactgacgcaaaagtgaaactaattaaacaagaactcgacaaatacaaaaatgctgtaacagacctacaaatgctaatgtgctcaacacccgcaaccggatcaggatcagccatagcctccggagtcgcagtatgcaaagtattacatcttgaaggagaagtaaataaaataaaatcagcattactatccacaaataaagccgtagtatcactatcaaacggtgtatccgtccttacattcaaagtattagatctaaaaaactacatagataaacaactactacccatcttaaacaaacaatcatgctcaattcccaacccagaaacagtcatggaatttcaacaaaaaaacaacagactcttagaaataacacgagaattttcagtaaacgcaggagtaaccacaccagtaagtacatacatgctcaccaactcagaattattatcacttattaacgacatgccaattacaaacgaccaaaaaaaattaatgtcaaacaatgtccaaattgttagacaacaatcatactctataatgtgtataataaaagaagaagtactagcttacgtagttcaattaccactatatggcgtaatagatacaccttgctggaaactacatacatctccattatgtacaactaacacaaaagaaggatctaacatatgcctaacacgcacagatcgaggatggtactgcgataatgcaggttccgtatcattctttccacaagcagaaacatgtaaagtatgctcaaacagagtattctgtgacactatgaactccttaaccctaccctcagaagtcaatctatgcaacgttgacatatttaacccaaaatacgactgtaaaatcatgacatctaaaacagacgtatcatcatcagttattacatccctaggagcaatagtatcttgctacggaaaaacaaaatgtacagcatccaacaaaaacaaaggaataatcaaaacattctcaaacggctgcgactacgtatcaaacaaaggtgtagacacagtatcagtaggaaatactttatattacgtaaataaacaagaaggacaatctctatacgttaaaggcgaacctattataaacttctacgacccactcgtattcccttcagacgaatttgacgcatctatatcccaagttaacgaaaaaatcaaccaatcattagcctttataagaaaatccgacgaattattacataacgtcaacgctggaaaatcaacaactaacataatgataaccacaataataatagtcatcatagttatattactaagtctaatagccgtaggcctcctactttattgcaaagcaagatcaacaccagtaacattatccaaagaccaactcagcggcataaacaatatagctttttcaaactagggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6096 - RNA, 1981 nt, synthetic construct
  misc_feature 1..1981: note = mRNA product Design a-3 comprising derived and/or modified sequence from HRSV(A2)__F_DSCav1_mut6 (opt11)
  source 1..1981: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcctcatcctcaaagccaacgcaatcacaaccatactaactgcagttactttctgcttcgcatccggccaaaacatcaccgaagagttctaccaatcaacctgctccgcagtctccaaaggatacctcggagcccttcgcaccggctggtacacctccgtcataaccatcgaactctcaaacataaaagaaaacaaatgcaacggcacagacgcgaaagtcaaacttatcaaacaagaactcgacaaatacaaaaacgccgtcaccgacctgcagatgctcatgtgctcaacccccgccacaggaagcggctctgctatcgcttccggcgtcgccgtctgcaaagtcctccacctcgaaggcgaagtaaacaaaatcaagtcagccctcctctccaccaacaaagccgtcgtctctctctcaaacggcgtatccgtcctcacattcaaagtcctcgacctcaaaaactacatcgacaaacaacttctccccatcctaaacaaacaatcatgctccatccccaaccccgaaacagtcatggaatttcaacaaaagaacaaccgcctcttagaaatcacccgagaattttccgtcaacgcgggagtcacaacccccgtttctacgtatatgctcaccaactccgaactcctttccctcataaacgacatgccaatcaccaacgaccaaaagaaactcatgtcaaacaacgtccaaatcgtccgacaacaatcctactctattatgtgcatcatcaaagaagaagttctcgcctacgtcgtccaactacccctctacggcgtgatcgacaccccctgctggaaactacacacctcacccctctgcaccaccaacaccaaggaaggctccaacatctgcctcacccgcaccgaccgcggctggtactgcgacaacgctggctccgtctcattcttcccgcaagccgaaacttgcaaagtatgctccaacagagtattctgcgacaccatgaactcactaaccctcccttccgaagtcaacctttgcaacgttgacatattcaacccaaagtacgattgcaaaattatgacatccaaaacagatgtctcctcctccgtcatcacatccctcggtgccattgtatcatgctacggaaaaaccaaatgcaccgcatccaacaaaaacaaaggaatcatcaaaaccttctcaaacggctgcgattacgtctcaaacaaaggagtcgacacagtctccgtcggaaacaccctatactacgtcaacaaacaagaaggccaatccctgtacgtcaaaggagaacccatcatcaacttctacgaccccctcgtcttcccgagcgacgagttcgacgcctccatctcacaagtcaatgaaaagatcaaccaatcccttgccttcatccggaaatcggacgaactcctacacaacgtgaacgctggaaaatcaaccaccaacatcatgatcacaaccatcattatcgtcatcatcgtcatactcctctccctaatcgccgtcggcctcctcctgtattgcaaagctcgctccacccccgtcaccctgtccaaagaccaactctccggaatcaacaacatcgccttctcaaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6097 - RNA, 1930 nt, synthetic construct
  misc_feature 1..1930: note = mRNA product Design a-4 comprising derived and/or modified sequence from HRSV(A2)__F_DSCav1_mut6 (opt1)
  source 1..1930: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaaccccgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6098 - RNA, 1930 nt, synthetic construct
  misc_feature 1..1930: note = mRNA product Design a-4 comprising derived and/or modified sequence from HRSV(A2)__F_DSCav1_mut6 (opt1)
  source 1..1930: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctcatgtgcagcacccccgccaccgggtccggcagcgccatcgcctccggcgtggcggtgtgcaaggtcctgcacctggagggggaggtgaacaagatcaagagcgccctcctgtccaccaacaaggccgtggtcagcctgtccaacggcgtgagcgtgctcacgttcaaggtcctggacctgaagaactacatcgacaagcagctcctgccgatcctgaacaagcagtcctgcagcatccccaaccccgagaccgtgatggagttccagcagaagaacaaccggctcctggagatcacccgcgagttctccgtgaacgccggggtcaccacgcccgtgagcacctacatgctgaccaactccgagctcctgagcctgatcaacgacatgccgatcaccaacgaccagaagaagctcatgagcaacaacgtgcagatcgtccggcagcagtcctacagcatcatgtgcatcatcaaggaggaggtgctggcctacgtggtccagctgcccctctacggcgtgatcgacacgccctgctggaagctgcacaccagccccctgtgcaccaccaacacgaaggaggggagcaacatctgcctcacccgcaccgaccggggctggtactgcgacaacgcgggctccgtgagcttcttcccgcaggccgagacctgcaaggtctgctccaaccgcgtgttctgcgacacgatgaacagcctgaccctgccctccgaggtcaacctctgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaacaaggggatcatcaagaccttctccaacggctgcgactacgtgagcaacaagggcgtcgacacggtgtccgtggggaacaccctgtactacgtcaacaagcaggagggccagagcctctacgtgaagggggagcccatcatcaacttctacgacccgctggtgttccccagcgacgagttcgacgcctccatcagccaggtcaacgagaagatcaaccagtccctggcgttcatccggaagtccgacgagctcctgcacaacgtgaacgccggcaagtccaccaccaacatcatgatcaccacgatcatcatcgtgatcatcgtcatcctgctcagcctgatcgccgtggggctgctcctgtactgcaaggcccgctccacccccgtgaccctgagcaaggaccagctgtccggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6099 - RNA, 1930 nt, synthetic construct
  misc_feature 1..1930: note = mRNA product Design a-4 comprising derived and/or modified sequence from HRSV(A2)__F_DSCav1_mut6 (opt2)
  source 1..1930: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6100 - RNA, 1930 nt, synthetic construct
  misc_feature 1..1930: note = mRNA product Design a-4 comprising derived and/or modified sequence from HRSV(A2)__F_DSCav1_mut6 (opt3)
  source 1..1930: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagatgcttatgtgttccacacccgccaccgggtctggatcggctatagcatcaggcgtggccgtctgcaaggtgctgcacttggagggtgaggttaacaaaatcaagagcgctctcctgagtacgaataaagccgtggtctccctgtctaacggggtgagcgtactcacttttaaggttttagatctgaagaattacattgacaaacagcttttgcctatcctgaacaagcaatcctgttcaattccaaatccggaaaccgtgatggagttccagcagaaaaacaataggctactcgaaatcacacgggagtttagtgtcaacgcgggagtgactacccccgtgagcacatatatgctgaccaattctgagcttctgtccttgataaacgatatgcctattacgaacgaccagaagaaactcatgtcaaataacgtccaaatcgttcgccagcagagctacagtattatgtgcatcatcaaggaagaggtgctggcatatgtagtgcagttaccactgtacggcgtcattgatactccctgttggaaactccatacatctcctctttgcaccactaatacaaaggaaggctccaacatatgtctgacccgaacggaccgtgggtggtactgcgataatgccggaagcgtgtcgttctttccacaagctgagacctgtaaggtttgctctaacagagtgttctgcgacacaatgaactccttgactctaccctcagaagtcaatctgtgtaatgtggatatctttaaccctaaatatgactgcaagattatgaccagtaaaacagatgtaagctcctctgttatcactagcctcggtgccatagtgtcatgttacggcaagaccaaatgcacagcaagtaataagaacaaggggattatcaaaaccttctccaatggatgtgactatgtcagcaacaagggcgtggacactgtctctgtgggtaatacgctgtactatgttaacaaacaggaggggcagtcactttacgtgaagggagagccaatcattaacttttatgatccgctggtattccccagtgacgaatttgatgctagcatctcccaagtcaatgagaaaattaaccagtctttggccttcataaggaagtcggacgaactcctgcacaatgtgaacgcgggcaagagcacaaccaatatcatgattactaccatcatcattgttataatcgtgattttactgtccctaatcgccgtcggcctcctgctttactgcaaagcacggtcaacacctgtgaccttgagtaaggatcagctgtctgggattaacaatatcgctttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6101 - RNA, 1930 nt, synthetic construct
  misc_feature 1..1930: note = mRNA product Design a-4 comprising derived and/or modified sequence from HRSV(A2)__F_DSCav1_mut6 (opt4)
  source 1..1930: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6102 - RNA, 1930 nt, synthetic construct
  misc_feature 1..1930: note = mRNA product Design a-4 comprising derived and/or modified sequence from HRSV(A2)__F_DSCav1_mut6 (opt5)
  source 1..1930: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagatgctgatgtgtagcacccccgccacaggatccggctctgctattgccagcggggtcgcggtgtgcaaggttctgcacctcgagggagaggtgaacaaaatcaagtccgccctgcttagcaccaataaagctgtcgtgtctctgtccaacggcgttagcgtgctcacatttaaggtcctggatcttaagaattacattgacaaacagctgctccctatcctgaacaagcaatcttgttccattccgaatcccgaaaccgtgatggagttccagcagaaaaacaatcggctgctcgaaatcacgcgcgagtttagcgtgaacgccggcgtcacaacccctgtttctacatatatgctgaccaattccgagcttctgagcctcattaacgatatgcccatcaccaacgaccagaagaaactgatgtccaataacgtgcaaatcgtgagacagcagtcttacagcattatgtgcatcattaaggaagaggtccttgcttatgtggttcagctgcctctctacggggtgatcgatacaccctgttggaaactgcatacgtcccctctgtgcaccacaaataccaaggaaggaagcaacatttgtctcacacggaccgaccgcggctggtactgcgataatgccgggtctgtctccttctttccgcaagcggagacgtgtaaggtgtgcagcaacagagttttctgcgacacaatgaactctctgacccttcccagcgaagtgaatctgtgtaatgtcgatatctttaaccctaaatatgactgcaagatcatgacctccaaaacagatgtgtctagctccgtcattaccagcctcggagccatcgtgtcttgttacggcaagacaaaatgcacggcttccaataagaacaaggggattatcaaaaccttcagcaatggatgtgactatgtttctaacaagggcgtggacacagtctccgtgggcaataccctgtactatgttaacaaacaggaggggcagagcctttacgtgaagggagagcccattatcaacttttatgatcctctggtcttcccctccgacgaatttgatgcctctatcagccaagtgaatgagaaaattaaccagtccctcgctttcatccggaagtctgacgaactgctgcacaatgtgaacgccggcaagagcacaaccaatattatgatcacgaccattatcattgttatcatcgtcattctcctgtcccttatcgccgtggggctgctcctgtactgcaaagctcgcagcacaccggtgaccctgtctaaggatcagctttccggaattaacaatatcgcgttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6103 - RNA, 1930 nt, synthetic construct
  misc_feature 1..1930: note = mRNA product Design a-4 comprising derived and/or modified sequence from HRSV(A2)__F_DSCav1_mut6 (opt6)
  source 1..1930: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactattaatcttaaaagcaaatgctataaccacaatattaacagcagtaacattctgttttgcctccggacaaaacataacagaagaattttatcaatcaacatgctctgcagtatccaaaggttacttaggcgcactacgcactggatggtatacatcagtaataacaatagaactatcaaacataaaagaaaataaatgtaacggtactgacgcaaaagtgaaactaattaaacaagaactcgacaaatacaaaaatgctgtaacagacctacaaatgctaatgtgctcaacacccgcaaccggatcaggatcagccatagcctccggagtcgcagtatgcaaagtattacatcttgaaggagaagtaaataaaataaaatcagcattactatccacaaataaagccgtagtatcactatcaaacggtgtatccgtccttacattcaaagtattagatctaaaaaactacatagataaacaactactacccatcttaaacaaacaatcatgctcaattcccaacccagaaacagtcatggaatttcaacaaaaaaacaacagactcttagaaataacacgagaattttcagtaaacgcaggagtaaccacaccagtaagtacatacatgctcaccaactcagaattattatcacttattaacgacatgccaattacaaacgaccaaaaaaaattaatgtcaaacaatgtccaaattgttagacaacaatcatactctataatgtgtataataaaagaagaagtactagcttacgtagttcaattaccactatatggcgtaatagatacaccttgctggaaactacatacatctccattatgtacaactaacacaaaagaaggatctaacatatgcctaacacgcacagatcgaggatggtactgcgataatgcaggttccgtatcattctttccacaagcagaaacatgtaaagtatgctcaaacagagtattctgtgacactatgaactccttaaccctaccctcagaagtcaatctatgcaacgttgacatatttaacccaaaatacgactgtaaaatcatgacatctaaaacagacgtatcatcatcagttattacatccctaggagcaatagtatcttgctacggaaaaacaaaatgtacagcatccaacaaaaacaaaggaataatcaaaacattctcaaacggctgcgactacgtatcaaacaaaggtgtagacacagtatcagtaggaaatactttatattacgtaaataaacaagaaggacaatctctatacgttaaaggcgaacctattataaacttctacgacccactcgtattcccttcagacgaatttgacgcatctatatcccaagttaacgaaaaaatcaaccaatcattagcctttataagaaaatccgacgaattattacataacgtcaacgctggaaaatcaacaactaacataatgataaccacaataataatagtcatcatagttatattactaagtctaatagccgtaggcctcctactttattgcaaagcaagatcaacaccagtaacattatccaaagaccaactcagcggcataaacaatatagctttttcaaactagggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6104 - RNA, 1930 nt, synthetic construct
  misc_feature 1..1930: note = mRNA product Design a-4 comprising derived and/or modified sequence from HRSV(A2)__F_DSCav1_mut6 (opt11)
  source 1..1930: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactcctcatcctcaaagccaacgcaatcacaaccatactaactgcagttactttctgcttcgcatccggccaaaacatcaccgaagagttctaccaatcaacctgctccgcagtctccaaaggatacctcggagcccttcgcaccggctggtacacctccgtcataaccatcgaactctcaaacataaaagaaaacaaatgcaacggcacagacgcgaaagtcaaacttatcaaacaagaactcgacaaatacaaaaacgccgtcaccgacctgcagatgctcatgtgctcaacccccgccacaggaagcggctctgctatcgcttccggcgtcgccgtctgcaaagtcctccacctcgaaggcgaagtaaacaaaatcaagtcagccctcctctccaccaacaaagccgtcgtctctctctcaaacggcgtatccgtcctcacattcaaagtcctcgacctcaaaaactacatcgacaaacaacttctccccatcctaaacaaacaatcatgctccatccccaaccccgaaacagtcatggaatttcaacaaaagaacaaccgcctcttagaaatcacccgagaattttccgtcaacgcgggagtcacaacccccgtttctacgtatatgctcaccaactccgaactcctttccctcataaacgacatgccaatcaccaacgaccaaaagaaactcatgtcaaacaacgtccaaatcgtccgacaacaatcctactctattatgtgcatcatcaaagaagaagttctcgcctacgtcgtccaactacccctctacggcgtgatcgacaccccctgctggaaactacacacctcacccctctgcaccaccaacaccaaggaaggctccaacatctgcctcacccgcaccgaccgcggctggtactgcgacaacgctggctccgtctcattcttcccgcaagccgaaacttgcaaagtatgctccaacagagtattctgcgacaccatgaactcactaaccctcccttccgaagtcaacctttgcaacgttgacatattcaacccaaagtacgattgcaaaattatgacatccaaaacagatgtctcctcctccgtcatcacatccctcggtgccattgtatcatgctacggaaaaaccaaatgcaccgcatccaacaaaaacaaaggaatcatcaaaaccttctcaaacggctgcgattacgtctcaaacaaaggagtcgacacagtctccgtcggaaacaccctatactacgtcaacaaacaagaaggccaatccctgtacgtcaaaggagaacccatcatcaacttctacgaccccctcgtcttcccgagcgacgagttcgacgcctccatctcacaagtcaatgaaaagatcaaccaatcccttgccttcatccggaaatcggacgaactcctacacaacgtgaacgctggaaaatcaaccaccaacatcatgatcacaaccatcattatcgtcatcatcgtcatactcctctccctaatcgccgtcggcctcctcctgtattgcaaagctcgctccacccccgtcaccctgtccaaagaccaactctccggaatcaacaacatcgccttctcaaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6105 - RNA, 1876 nt, synthetic construct
  misc_feature 1..1876: note = mRNA product Design a-5 comprising derived and/or modified sequence from HRSV(A2)__F_DSCav1_mut6 (opt1)
  source 1..1876: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaaccccgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6106 - RNA, 1876 nt, synthetic construct
  misc_feature 1..1876: note = mRNA product Design a-5 comprising derived and/or modified sequence from HRSV(A2)__F_DSCav1_mut6 (opt1)
  source 1..1876: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctcatgtgcagcacccccgccaccgggtccggcagcgccatcgcctccggcgtggcggtgtgcaaggtcctgcacctggagggggaggtgaacaagatcaagagcgccctcctgtccaccaacaaggccgtggtcagcctgtccaacggcgtgagcgtgctcacgttcaaggtcctggacctgaagaactacatcgacaagcagctcctgccgatcctgaacaagcagtcctgcagcatccccaaccccgagaccgtgatggagttccagcagaagaacaaccggctcctggagatcacccgcgagttctccgtgaacgccggggtcaccacgcccgtgagcacctacatgctgaccaactccgagctcctgagcctgatcaacgacatgccgatcaccaacgaccagaagaagctcatgagcaacaacgtgcagatcgtccggcagcagtcctacagcatcatgtgcatcatcaaggaggaggtgctggcctacgtggtccagctgcccctctacggcgtgatcgacacgccctgctggaagctgcacaccagccccctgtgcaccaccaacacgaaggaggggagcaacatctgcctcacccgcaccgaccggggctggtactgcgacaacgcgggctccgtgagcttcttcccgcaggccgagacctgcaaggtctgctccaaccgcgtgttctgcgacacgatgaacagcctgaccctgccctccgaggtcaacctctgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaacaaggggatcatcaagaccttctccaacggctgcgactacgtgagcaacaagggcgtcgacacggtgtccgtggggaacaccctgtactacgtcaacaagcaggagggccagagcctctacgtgaagggggagcccatcatcaacttctacgacccgctggtgttccccagcgacgagttcgacgcctccatcagccaggtcaacgagaagatcaaccagtccctggcgttcatccggaagtccgacgagctcctgcacaacgtgaacgccggcaagtccaccaccaacatcatgatcaccacgatcatcatcgtgatcatcgtcatcctgctcagcctgatcgccgtggggctgctcctgtactgcaaggcccgctccacccccgtgaccctgagcaaggaccagctgtccggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6107 - RNA, 1876 nt, synthetic construct
  misc_feature 1..1876: note = mRNA product Design a-5 comprising derived and/or modified sequence from HRSV(A2)__F_DSCav1_mut6 (opt2)
  source 1..1876: mol_type = other RNA
gggagactttcccattctgtagcagaatttggtgttgcctgtggtcttggtcccgcggagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6108 - RNA, 1876 nt, synthetic construct
  misc_feature 1..1876: note = mRNA product Design a-5 comprising derived and/or modified sequence from HRSV(A2)__F_DSCav1_mut6 (opt3)
  source 1..1876: mol_type = other RNA
gggagactttcccattctgtagcagaatttggtgttgcctgtggtcttggtcccgcggagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagatgcttatgtgttccacacccgccaccgggtctggatcggctatagcatcaggcgtggccgtctgcaaggtgctgcacttggagggtgaggttaacaaaatcaagagcgctctcctgagtacgaataaagccgtggtctccctgtctaacggggtgagcgtactcacttttaaggttttagatctgaagaattacattgacaaacagcttttgcctatcctgaacaagcaatcctgttcaattccaaatccggaaaccgtgatggagttccagcagaaaaacaataggctactcgaaatcacacgggagtttagtgtcaacgcgggagtgactacccccgtgagcacatatatgctgaccaattctgagcttctgtccttgataaacgatatgcctattacgaacgaccagaagaaactcatgtcaaataacgtccaaatcgttcgccagcagagctacagtattatgtgcatcatcaaggaagaggtgctggcatatgtagtgcagttaccactgtacggcgtcattgatactccctgttggaaactccatacatctcctctttgcaccactaatacaaaggaaggctccaacatatgtctgacccgaacggaccgtgggtggtactgcgataatgccggaagcgtgtcgttctttccacaagctgagacctgtaaggtttgctctaacagagtgttctgcgacacaatgaactccttgactctaccctcagaagtcaatctgtgtaatgtggatatctttaaccctaaatatgactgcaagattatgaccagtaaaacagatgtaagctcctctgttatcactagcctcggtgccatagtgtcatgttacggcaagaccaaatgcacagcaagtaataagaacaaggggattatcaaaaccttctccaatggatgtgactatgtcagcaacaagggcgtggacactgtctctgtgggtaatacgctgtactatgttaacaaacaggaggggcagtcactttacgtgaagggagagccaatcattaacttttatgatccgctggtattccccagtgacgaatttgatgctagcatctcccaagtcaatgagaaaattaaccagtctttggccttcataaggaagtcggacgaactcctgcacaatgtgaacgcgggcaagagcacaaccaatatcatgattactaccatcatcattgttataatcgtgattttactgtccctaatcgccgtcggcctcctgctttactgcaaagcacggtcaacacctgtgaccttgagtaaggatcagctgtctgggattaacaatatcgctttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6109 - RNA, 1876 nt, synthetic construct
  misc_feature 1..1876: note = mRNA product Design a-5 comprising derived and/or modified sequence from HRSV(A2)__F_DSCav1_mut6 (opt4)
  source 1..1876: mol_type = other RNA
gggagactttcccattctgtagcagaatttggtgttgcctgtggtcttggtcccgcggagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6110 - RNA, 1876 nt, synthetic construct
  misc_feature 1..1876: note = mRNA product Design a-5 comprising derived and/or modified sequence from HRSV(A2)__F_DSCav1_mut6 (opt5)
  source 1..1876: mol_type = other RNA
gggagactttcccattctgtagcagaatttggtgttgcctgtggtcttggtcccgcggagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagatgctgatgtgtagcacccccgccacaggatccggctctgctattgccagcggggtcgcggtgtgcaaggttctgcacctcgagggagaggtgaacaaaatcaagtccgccctgcttagcaccaataaagctgtcgtgtctctgtccaacggcgttagcgtgctcacatttaaggtcctggatcttaagaattacattgacaaacagctgctccctatcctgaacaagcaatcttgttccattccgaatcccgaaaccgtgatggagttccagcagaaaaacaatcggctgctcgaaatcacgcgcgagtttagcgtgaacgccggcgtcacaacccctgtttctacatatatgctgaccaattccgagcttctgagcctcattaacgatatgcccatcaccaacgaccagaagaaactgatgtccaataacgtgcaaatcgtgagacagcagtcttacagcattatgtgcatcattaaggaagaggtccttgcttatgtggttcagctgcctctctacggggtgatcgatacaccctgttggaaactgcatacgtcccctctgtgcaccacaaataccaaggaaggaagcaacatttgtctcacacggaccgaccgcggctggtactgcgataatgccgggtctgtctccttctttccgcaagcggagacgtgtaaggtgtgcagcaacagagttttctgcgacacaatgaactctctgacccttcccagcgaagtgaatctgtgtaatgtcgatatctttaaccctaaatatgactgcaagatcatgacctccaaaacagatgtgtctagctccgtcattaccagcctcggagccatcgtgtcttgttacggcaagacaaaatgcacggcttccaataagaacaaggggattatcaaaaccttcagcaatggatgtgactatgtttctaacaagggcgtggacacagtctccgtgggcaataccctgtactatgttaacaaacaggaggggcagagcctttacgtgaagggagagcccattatcaacttttatgatcctctggtcttcccctccgacgaatttgatgcctctatcagccaagtgaatgagaaaattaaccagtccctcgctttcatccggaagtctgacgaactgctgcacaatgtgaacgccggcaagagcacaaccaatattatgatcacgaccattatcattgttatcatcgtcattctcctgtcccttatcgccgtggggctgctcctgtactgcaaagctcgcagcacaccggtgaccctgtctaaggatcagctttccggaattaacaatatcgcgttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6111 - RNA, 1876 nt, synthetic construct
  misc_feature 1..1876: note = mRNA product Design a-5 comprising derived and/or modified sequence from HRSV(A2)__F_DSCav1_mut6 (opt6)
  source 1..1876: mol_type = other RNA
gggagactttcccattctgtagcagaatttggtgttgcctgtggtcttggtcccgcggagaagcttaccatggaactattaatcttaaaagcaaatgctataaccacaatattaacagcagtaacattctgttttgcctccggacaaaacataacagaagaattttatcaatcaacatgctctgcagtatccaaaggttacttaggcgcactacgcactggatggtatacatcagtaataacaatagaactatcaaacataaaagaaaataaatgtaacggtactgacgcaaaagtgaaactaattaaacaagaactcgacaaatacaaaaatgctgtaacagacctacaaatgctaatgtgctcaacacccgcaaccggatcaggatcagccatagcctccggagtcgcagtatgcaaagtattacatcttgaaggagaagtaaataaaataaaatcagcattactatccacaaataaagccgtagtatcactatcaaacggtgtatccgtccttacattcaaagtattagatctaaaaaactacatagataaacaactactacccatcttaaacaaacaatcatgctcaattcccaacccagaaacagtcatggaatttcaacaaaaaaacaacagactcttagaaataacacgagaattttcagtaaacgcaggagtaaccacaccagtaagtacatacatgctcaccaactcagaattattatcacttattaacgacatgccaattacaaacgaccaaaaaaaattaatgtcaaacaatgtccaaattgttagacaacaatcatactctataatgtgtataataaaagaagaagtactagcttacgtagttcaattaccactatatggcgtaatagatacaccttgctggaaactacatacatctccattatgtacaactaacacaaaagaaggatctaacatatgcctaacacgcacagatcgaggatggtactgcgataatgcaggttccgtatcattctttccacaagcagaaacatgtaaagtatgctcaaacagagtattctgtgacactatgaactccttaaccctaccctcagaagtcaatctatgcaacgttgacatatttaacccaaaatacgactgtaaaatcatgacatctaaaacagacgtatcatcatcagttattacatccctaggagcaatagtatcttgctacggaaaaacaaaatgtacagcatccaacaaaaacaaaggaataatcaaaacattctcaaacggctgcgactacgtatcaaacaaaggtgtagacacagtatcagtaggaaatactttatattacgtaaataaacaagaaggacaatctctatacgttaaaggcgaacctattataaacttctacgacccactcgtattcccttcagacgaatttgacgcatctatatcccaagttaacgaaaaaatcaaccaatcattagcctttataagaaaatccgacgaattattacataacgtcaacgctggaaaatcaacaactaacataatgataaccacaataataatagtcatcatagttatattactaagtctaatagccgtaggcctcctactttattgcaaagcaagatcaacaccagtaacattatccaaagaccaactcagcggcataaacaatatagctttttcaaactagggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6112 - RNA, 1876 nt, synthetic construct
  misc_feature 1..1876: note = mRNA product Design a-5 comprising derived and/or modified sequence from HRSV(A2)__F_DSCav1_mut6 (opt11)
  source 1..1876: mol_type = other RNA
gggagactttcccattctgtagcagaatttggtgttgcctgtggtcttggtcccgcggagaagcttaccatggaactcctcatcctcaaagccaacgcaatcacaaccatactaactgcagttactttctgcttcgcatccggccaaaacatcaccgaagagttctaccaatcaacctgctccgcagtctccaaaggatacctcggagcccttcgcaccggctggtacacctccgtcataaccatcgaactctcaaacataaaagaaaacaaatgcaacggcacagacgcgaaagtcaaacttatcaaacaagaactcgacaaatacaaaaacgccgtcaccgacctgcagatgctcatgtgctcaacccccgccacaggaagcggctctgctatcgcttccggcgtcgccgtctgcaaagtcctccacctcgaaggcgaagtaaacaaaatcaagtcagccctcctctccaccaacaaagccgtcgtctctctctcaaacggcgtatccgtcctcacattcaaagtcctcgacctcaaaaactacatcgacaaacaacttctccccatcctaaacaaacaatcatgctccatccccaaccccgaaacagtcatggaatttcaacaaaagaacaaccgcctcttagaaatcacccgagaattttccgtcaacgcgggagtcacaacccccgtttctacgtatatgctcaccaactccgaactcctttccctcataaacgacatgccaatcaccaacgaccaaaagaaactcatgtcaaacaacgtccaaatcgtccgacaacaatcctactctattatgtgcatcatcaaagaagaagttctcgcctacgtcgtccaactacccctctacggcgtgatcgacaccccctgctggaaactacacacctcacccctctgcaccaccaacaccaaggaaggctccaacatctgcctcacccgcaccgaccgcggctggtactgcgacaacgctggctccgtctcattcttcccgcaagccgaaacttgcaaagtatgctccaacagagtattctgcgacaccatgaactcactaaccctcccttccgaagtcaacctttgcaacgttgacatattcaacccaaagtacgattgcaaaattatgacatccaaaacagatgtctcctcctccgtcatcacatccctcggtgccattgtatcatgctacggaaaaaccaaatgcaccgcatccaacaaaaacaaaggaatcatcaaaaccttctcaaacggctgcgattacgtctcaaacaaaggagtcgacacagtctccgtcggaaacaccctatactacgtcaacaaacaagaaggccaatccctgtacgtcaaaggagaacccatcatcaacttctacgaccccctcgtcttcccgagcgacgagttcgacgcctccatctcacaagtcaatgaaaagatcaaccaatcccttgccttcatccggaaatcggacgaactcctacacaacgtgaacgctggaaaatcaaccaccaacatcatgatcacaaccatcattatcgtcatcatcgtcatactcctctccctaatcgccgtcggcctcctcctgtattgcaaagctcgctccacccccgtcaccctgtccaaagaccaactctccggaatcaacaacatcgccttctcaaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6113 - RNA, 2057 nt, synthetic construct
  misc_feature 1..2057: note = mRNA product Design b-1 comprising derived and/or modified sequence from HRSV(A2)__F_DSCav1_mut6 (opt1)
  source 1..2057: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaaccccgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6114 - RNA, 2057 nt, synthetic construct
  misc_feature 1..2057: note = mRNA product Design b-1 comprising derived and/or modified sequence from HRSV(A2)__F_DSCav1_mut6 (opt1)
  source 1..2057: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctcatgtgcagcacccccgccaccgggtccggcagcgccatcgcctccggcgtggcggtgtgcaaggtcctgcacctggagggggaggtgaacaagatcaagagcgccctcctgtccaccaacaaggccgtggtcagcctgtccaacggcgtgagcgtgctcacgttcaaggtcctggacctgaagaactacatcgacaagcagctcctgccgatcctgaacaagcagtcctgcagcatccccaaccccgagaccgtgatggagttccagcagaagaacaaccggctcctggagatcacccgcgagttctccgtgaacgccggggtcaccacgcccgtgagcacctacatgctgaccaactccgagctcctgagcctgatcaacgacatgccgatcaccaacgaccagaagaagctcatgagcaacaacgtgcagatcgtccggcagcagtcctacagcatcatgtgcatcatcaaggaggaggtgctggcctacgtggtccagctgcccctctacggcgtgatcgacacgccctgctggaagctgcacaccagccccctgtgcaccaccaacacgaaggaggggagcaacatctgcctcacccgcaccgaccggggctggtactgcgacaacgcgggctccgtgagcttcttcccgcaggccgagacctgcaaggtctgctccaaccgcgtgttctgcgacacgatgaacagcctgaccctgccctccgaggtcaacctctgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaacaaggggatcatcaagaccttctccaacggctgcgactacgtgagcaacaagggcgtcgacacggtgtccgtggggaacaccctgtactacgtcaacaagcaggagggccagagcctctacgtgaagggggagcccatcatcaacttctacgacccgctggtgttccccagcgacgagttcgacgcctccatcagccaggtcaacgagaagatcaaccagtccctggcgttcatccggaagtccgacgagctcctgcacaacgtgaacgccggcaagtccaccaccaacatcatgatcaccacgatcatcatcgtgatcatcgtcatcctgctcagcctgatcgccgtggggctgctcctgtactgcaaggcccgctccacccccgtgaccctgagcaaggaccagctgtccggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6115 - RNA, 2057 nt, synthetic construct
  misc_feature 1..2057: note = mRNA product Design b-1 comprising derived and/or modified sequence from HRSV(A2)__F_DSCav1_mut6 (opt2)
  source 1..2057: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6116 - RNA, 2057 nt, synthetic construct
  misc_feature 1..2057: note = mRNA product Design b-1 comprising derived and/or modified sequence from HRSV(A2)__F_DSCav1_mut6 (opt3)
  source 1..2057: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagatgcttatgtgttccacacccgccaccgggtctggatcggctatagcatcaggcgtggccgtctgcaaggtgctgcacttggagggtgaggttaacaaaatcaagagcgctctcctgagtacgaataaagccgtggtctccctgtctaacggggtgagcgtactcacttttaaggttttagatctgaagaattacattgacaaacagcttttgcctatcctgaacaagcaatcctgttcaattccaaatccggaaaccgtgatggagttccagcagaaaaacaataggctactcgaaatcacacgggagtttagtgtcaacgcgggagtgactacccccgtgagcacatatatgctgaccaattctgagcttctgtccttgataaacgatatgcctattacgaacgaccagaagaaactcatgtcaaataacgtccaaatcgttcgccagcagagctacagtattatgtgcatcatcaaggaagaggtgctggcatatgtagtgcagttaccactgtacggcgtcattgatactccctgttggaaactccatacatctcctctttgcaccactaatacaaaggaaggctccaacatatgtctgacccgaacggaccgtgggtggtactgcgataatgccggaagcgtgtcgttctttccacaagctgagacctgtaaggtttgctctaacagagtgttctgcgacacaatgaactccttgactctaccctcagaagtcaatctgtgtaatgtggatatctttaaccctaaatatgactgcaagattatgaccagtaaaacagatgtaagctcctctgttatcactagcctcggtgccatagtgtcatgttacggcaagaccaaatgcacagcaagtaataagaacaaggggattatcaaaaccttctccaatggatgtgactatgtcagcaacaagggcgtggacactgtctctgtgggtaatacgctgtactatgttaacaaacaggaggggcagtcactttacgtgaagggagagccaatcattaacttttatgatccgctggtattccccagtgacgaatttgatgctagcatctcccaagtcaatgagaaaattaaccagtctttggccttcataaggaagtcggacgaactcctgcacaatgtgaacgcgggcaagagcacaaccaatatcatgattactaccatcatcattgttataatcgtgattttactgtccctaatcgccgtcggcctcctgctttactgcaaagcacggtcaacacctgtgaccttgagtaaggatcagctgtctgggattaacaatatcgctttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6117 - RNA, 2057 nt, synthetic construct
  misc_feature 1..2057: note = mRNA product Design b-1 comprising derived and/or modified sequence from HRSV(A2)__F_DSCav1_mut6 (opt4)
  source 1..2057: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6118 - RNA, 2057 nt, synthetic construct
  misc_feature 1..2057: note = mRNA product Design b-1 comprising derived and/or modified sequence from HRSV(A2)__F_DSCav1_mut6 (opt5)
  source 1..2057: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagatgctgatgtgtagcacccccgccacaggatccggctctgctattgccagcggggtcgcggtgtgcaaggttctgcacctcgagggagaggtgaacaaaatcaagtccgccctgcttagcaccaataaagctgtcgtgtctctgtccaacggcgttagcgtgctcacatttaaggtcctggatcttaagaattacattgacaaacagctgctccctatcctgaacaagcaatcttgttccattccgaatcccgaaaccgtgatggagttccagcagaaaaacaatcggctgctcgaaatcacgcgcgagtttagcgtgaacgccggcgtcacaacccctgtttctacatatatgctgaccaattccgagcttctgagcctcattaacgatatgcccatcaccaacgaccagaagaaactgatgtccaataacgtgcaaatcgtgagacagcagtcttacagcattatgtgcatcattaaggaagaggtccttgcttatgtggttcagctgcctctctacggggtgatcgatacaccctgttggaaactgcatacgtcccctctgtgcaccacaaataccaaggaaggaagcaacatttgtctcacacggaccgaccgcggctggtactgcgataatgccgggtctgtctccttctttccgcaagcggagacgtgtaaggtgtgcagcaacagagttttctgcgacacaatgaactctctgacccttcccagcgaagtgaatctgtgtaatgtcgatatctttaaccctaaatatgactgcaagatcatgacctccaaaacagatgtgtctagctccgtcattaccagcctcggagccatcgtgtcttgttacggcaagacaaaatgcacggcttccaataagaacaaggggattatcaaaaccttcagcaatggatgtgactatgtttctaacaagggcgtggacacagtctccgtgggcaataccctgtactatgttaacaaacaggaggggcagagcctttacgtgaagggagagcccattatcaacttttatgatcctctggtcttcccctccgacgaatttgatgcctctatcagccaagtgaatgagaaaattaaccagtccctcgctttcatccggaagtctgacgaactgctgcacaatgtgaacgccggcaagagcacaaccaatattatgatcacgaccattatcattgttatcatcgtcattctcctgtcccttatcgccgtggggctgctcctgtactgcaaagctcgcagcacaccggtgaccctgtctaaggatcagctttccggaattaacaatatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6119 - RNA, 2057 nt, synthetic construct
  misc_feature 1..2057: note = mRNA product Design b-1 comprising derived and/or modified sequence from HRSV(A2)__F_DSCav1_mut6 (opt6)
  source 1..2057: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggaactattaatcttaaaagcaaatgctataaccacaatattaacagcagtaacattctgttttgcctccggacaaaacataacagaagaattttatcaatcaacatgctctgcagtatccaaaggttacttaggcgcactacgcactggatggtatacatcagtaataacaatagaactatcaaacataaaagaaaataaatgtaacggtactgacgcaaaagtgaaactaattaaacaagaactcgacaaatacaaaaatgctgtaacagacctacaaatgctaatgtgctcaacacccgcaaccggatcaggatcagccatagcctccggagtcgcagtatgcaaagtattacatcttgaaggagaagtaaataaaataaaatcagcattactatccacaaataaagccgtagtatcactatcaaacggtgtatccgtccttacattcaaagtattagatctaaaaaactacatagataaacaactactacccatcttaaacaaacaatcatgctcaattcccaacccagaaacagtcatggaatttcaacaaaaaaacaacagactcttagaaataacacgagaattttcagtaaacgcaggagtaaccacaccagtaagtacatacatgctcaccaactcagaattattatcacttattaacgacatgccaattacaaacgaccaaaaaaaattaatgtcaaacaatgtccaaattgttagacaacaatcatactctataatgtgtataataaaagaagaagtactagcttacgtagttcaattaccactatatggcgtaatagatacaccttgctggaaactacatacatctccattatgtacaactaacacaaaagaaggatctaacatatgcctaacacgcacagatcgaggatggtactgcgataatgcaggttccgtatcattctttccacaagcagaaacatgtaaagtatgctcaaacagagtattctgtgacactatgaactccttaaccctaccctcagaagtcaatctatgcaacgttgacatatttaacccaaaatacgactgtaaaatcatgacatctaaaacagacgtatcatcatcagttattacatccctaggagcaatagtatcttgctacggaaaaacaaaatgtacagcatccaacaaaaacaaaggaataatcaaaacattctcaaacggctgcgactacgtatcaaacaaaggtgtagacacagtatcagtaggaaatactttatattacgtaaataaacaagaaggacaatctctatacgttaaaggcgaacctattataaacttctacgacccactcgtattcccttcagacgaatttgacgcatctatatcccaagttaacgaaaaaatcaaccaatcattagcctttataagaaaatccgacgaattattacataacgtcaacgctggaaaatcaacaactaacataatgataaccacaataataatagtcatcatagttatattactaagtctaatagccgtaggcctcctactttattgcaaagcaagatcaacaccagtaacattatccaaagaccaactcagcggcataaacaatatagctttttcaaactagggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6120 - RNA, 2057 nt, synthetic construct
  misc_feature 1..2057: note = mRNA product Design b-1 comprising derived and/or modified sequence from HRSV(A2)__F_DSCav1_mut6 (opt11)
  source 1..2057: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggaactcctcatcctcaaagccaacgcaatcacaaccatactaactgcagttactttctgcttcgcatccggccaaaacatcaccgaagagttctaccaatcaacctgctccgcagtctccaaaggatacctcggagcccttcgcaccggctggtacacctccgtcataaccatcgaactctcaaacataaaagaaaacaaatgcaacggcacagacgcgaaagtcaaacttatcaaacaagaactcgacaaatacaaaaacgccgtcaccgacctgcagatgctcatgtgctcaacccccgccacaggaagcggctctgctatcgcttccggcgtcgccgtctgcaaagtcctccacctcgaaggcgaagtaaacaaaatcaagtcagccctcctctccaccaacaaagccgtcgtctctctctcaaacggcgtatccgtcctcacattcaaagtcctcgacctcaaaaactacatcgacaaacaacttctccccatcctaaacaaacaatcatgctccatccccaaccccgaaacagtcatggaatttcaacaaaagaacaaccgcctcttagaaatcacccgagaattttccgtcaacgcgggagtcacaacccccgtttctacgtatatgctcaccaactccgaactcctttccctcataaacgacatgccaatcaccaacgaccaaaagaaactcatgtcaaacaacgtccaaatcgtccgacaacaatcctactctattatgtgcatcatcaaagaagaagttctcgcctacgtcgtccaactacccctctacggcgtgatcgacaccccctgctggaaactacacacctcacccctctgcaccaccaacaccaaggaaggctccaacatctgcctcacccgcaccgaccgcggctggtactgcgacaacgctggctccgtctcattcttcccgcaagccgaaacttgcaaagtatgctccaacagagtattctgcgacaccatgaactcactaaccctcccttccgaagtcaacctttgcaacgttgacatattcaacccaaagtacgattgcaaaattatgacatccaaaacagatgtctcctcctccgtcatcacatccctcggtgccattgtatcatgctacggaaaaaccaaatgcaccgcatccaacaaaaacaaaggaatcatcaaaaccttctcaaacggctgcgattacgtctcaaacaaaggagtcgacacagtctccgtcggaaacaccctatactacgtcaacaaacaagaaggccaatccctgtacgtcaaaggagaacccatcatcaacttctacgaccccctcgtcttcccgagcgacgagttcgacgcctccatctcacaagtcaatgaaaagatcaaccaatcccttgccttcatccggaaatcggacgaactcctacacaacgtgaacgctggaaaatcaaccaccaacatcatgatcacaaccatcattatcgtcatcatcgtcatactcctctccctaatcgccgtcggcctcctcctgtattgcaaagctcgctccacccccgtcaccctgtccaaagaccaactctccggaatcaacaacatcgccttctcaaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6121 - RNA, 1877 nt, synthetic construct
  misc_feature 1..1877: note = mRNA product Design b-2 comprising derived and/or modified sequence from HRSV(A2)__F_DSCav1_mut6 (opt1)
  source 1..1877: mol_type = other RNA
gggagagcctctgctggagtccggggagtggcgttggctgctagagcgaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaaccccgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6122 - RNA, 1877 nt, synthetic construct
  misc_feature 1..1877: note = mRNA product Design b-2 comprising derived and/or modified sequence from HRSV(A2)__F_DSCav1_mut6 (opt1)
  source 1..1877: mol_type = other RNA
gggagagcctctgctggagtccggggagtggcgttggctgctagagcgaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctcatgtgcagcacccccgccaccgggtccggcagcgccatcgcctccggcgtggcggtgtgcaaggtcctgcacctggagggggaggtgaacaagatcaagagcgccctcctgtccaccaacaaggccgtggtcagcctgtccaacggcgtgagcgtgctcacgttcaaggtcctggacctgaagaactacatcgacaagcagctcctgccgatcctgaacaagcagtcctgcagcatccccaaccccgagaccgtgatggagttccagcagaagaacaaccggctcctggagatcacccgcgagttctccgtgaacgccggggtcaccacgcccgtgagcacctacatgctgaccaactccgagctcctgagcctgatcaacgacatgccgatcaccaacgaccagaagaagctcatgagcaacaacgtgcagatcgtccggcagcagtcctacagcatcatgtgcatcatcaaggaggaggtgctggcctacgtggtccagctgcccctctacggcgtgatcgacacgccctgctggaagctgcacaccagccccctgtgcaccaccaacacgaaggaggggagcaacatctgcctcacccgcaccgaccggggctggtactgcgacaacgcgggctccgtgagcttcttcccgcaggccgagacctgcaaggtctgctccaaccgcgtgttctgcgacacgatgaacagcctgaccctgccctccgaggtcaacctctgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaacaaggggatcatcaagaccttctccaacggctgcgactacgtgagcaacaagggcgtcgacacggtgtccgtggggaacaccctgtactacgtcaacaagcaggagggccagagcctctacgtgaagggggagcccatcatcaacttctacgacccgctggtgttccccagcgacgagttcgacgcctccatcagccaggtcaacgagaagatcaaccagtccctggcgttcatccggaagtccgacgagctcctgcacaacgtgaacgccggcaagtccaccaccaacatcatgatcaccacgatcatcatcgtgatcatcgtcatcctgctcagcctgatcgccgtggggctgctcctgtactgcaaggcccgctccacccccgtgaccctgagcaaggaccagctgtccggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6123 - RNA, 1877 nt, synthetic construct
  misc_feature 1..1877: note = mRNA product Design b-2 comprising derived and/or modified sequence from HRSV(A2)__F_DSCav1_mut6 (opt2)
  source 1..1877: mol_type = other RNA
gggagagcctctgctggagtccggggagtggcgttggctgctagagcgaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6124 - RNA, 1877 nt, synthetic construct
  misc_feature 1..1877: note = mRNA product Design b-2 comprising derived and/or modified sequence from HRSV(A2)__F_DSCav1_mut6 (opt3)
  source 1..1877: mol_type = other RNA
gggagagcctctgctggagtccggggagtggcgttggctgctagagcgaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagatgcttatgtgttccacacccgccaccgggtctggatcggctatagcatcaggcgtggccgtctgcaaggtgctgcacttggagggtgaggttaacaaaatcaagagcgctctcctgagtacgaataaagccgtggtctccctgtctaacggggtgagcgtactcacttttaaggttttagatctgaagaattacattgacaaacagcttttgcctatcctgaacaagcaatcctgttcaattccaaatccggaaaccgtgatggagttccagcagaaaaacaataggctactcgaaatcacacgggagtttagtgtcaacgcgggagtgactacccccgtgagcacatatatgctgaccaattctgagcttctgtccttgataaacgatatgcctattacgaacgaccagaagaaactcatgtcaaataacgtccaaatcgttcgccagcagagctacagtattatgtgcatcatcaaggaagaggtgctggcatatgtagtgcagttaccactgtacggcgtcattgatactccctgttggaaactccatacatctcctctttgcaccactaatacaaaggaaggctccaacatatgtctgacccgaacggaccgtgggtggtactgcgataatgccggaagcgtgtcgttctttccacaagctgagacctgtaaggtttgctctaacagagtgttctgcgacacaatgaactccttgactctaccctcagaagtcaatctgtgtaatgtggatatctttaaccctaaatatgactgcaagattatgaccagtaaaacagatgtaagctcctctgttatcactagcctcggtgccatagtgtcatgttacggcaagaccaaatgcacagcaagtaataagaacaaggggattatcaaaaccttctccaatggatgtgactatgtcagcaacaagggcgtggacactgtctctgtgggtaatacgctgtactatgttaacaaacaggaggggcagtcactttacgtgaagggagagccaatcattaacttttatgatccgctggtattccccagtgacgaatttgatgctagcatctcccaagtcaatgagaaaattaaccagtctttggccttcataaggaagtcggacgaactcctgcacaatgtgaacgcgggcaagagcacaaccaatatcatgattactaccatcatcattgttataatcgtgattttactgtccctaatcgccgtcggcctcctgctttactgcaaagcacggtcaacacctgtgaccttgagtaaggatcagctgtctgggattaacaatatcgctttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6125 - RNA, 1877 nt, synthetic construct
  misc_feature 1..1877: note = mRNA product Design b-2 comprising derived and/or modified sequence from HRSV(A2)__F_DSCav1_mut6 (opt4)
  source 1..1877: mol_type = other RNA
gggagagcctctgctggagtccggggagtggcgttggctgctagagcgaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6126 - RNA, 1877 nt, synthetic construct
  misc_feature 1..1877: note = mRNA product Design b-2 comprising derived and/or modified sequence from HRSV(A2)__F_DSCav1_mut6 (opt5)
  source 1..1877: mol_type = other RNA
gggagagcctctgctggagtccggggagtggcgttggctgctagagcgaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagatgctgatgtgtagcacccccgccacaggatccggctctgctattgccagcggggtcgcggtgtgcaaggttctgcacctcgagggagaggtgaacaaaatcaagtccgccctgcttagcaccaataaagctgtcgtgtctctgtccaacggcgttagcgtgctcacatttaaggtcctggatcttaagaattacattgacaaacagctgctccctatcctgaacaagcaatcttgttccattccgaatcccgaaaccgtgatggagttccagcagaaaaacaatcggctgctcgaaatcacgcgcgagtttagcgtgaacgccggcgtcacaacccctgtttctacatatatgctgaccaattccgagcttctgagcctcattaacgatatgcccatcaccaacgaccagaagaaactgatgtccaataacgtgcaaatcgtgagacagcagtcttacagcattatgtgcatcattaaggaagaggtccttgcttatgtggttcagctgcctctctacggggtgatcgatacaccctgttggaaactgcatacgtcccctctgtgcaccacaaataccaaggaaggaagcaacatttgtctcacacggaccgaccgcggctggtactgcgataatgccgggtctgtctccttctttccgcaagcggagacgtgtaaggtgtgcagcaacagagttttctgcgacacaatgaactctctgacccttcccagcgaagtgaatctgtgtaatgtcgatatctttaaccctaaatatgactgcaagatcatgacctccaaaacagatgtgtctagctccgtcattaccagcctcggagccatcgtgtcttgttacggcaagacaaaatgcacggcttccaataagaacaaggggattatcaaaaccttcagcaatggatgtgactatgtttctaacaagggcgtggacacagtctccgtgggcaataccctgtactatgttaacaaacaggaggggcagagcctttacgtgaagggagagcccattatcaacttttatgatcctctggtcttcccctccgacgaatttgatgcctctatcagccaagtgaatgagaaaattaaccagtccctcgctttcatccggaagtctgacgaactgctgcacaatgtgaacgccggcaagagcacaaccaatattatgatcacgaccattatcattgttatcatcgtcattctcctgtcccttatcgccgtggggctgctcctgtactgcaaagctcgcagcacaccggtgaccctgtctaaggatcagctttccggaattaacaatatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6127 - RNA, 1877 nt, synthetic construct
  misc_feature 1..1877: note = mRNA product Design b-2 comprising derived and/or modified sequence from HRSV(A2)__F_DSCav1_mut6 (opt6)
  source 1..1877: mol_type = other RNA
gggagagcctctgctggagtccggggagtggcgttggctgctagagcgaagcttaccatggaactattaatcttaaaagcaaatgctataaccacaatattaacagcagtaacattctgttttgcctccggacaaaacataacagaagaattttatcaatcaacatgctctgcagtatccaaaggttacttaggcgcactacgcactggatggtatacatcagtaataacaatagaactatcaaacataaaagaaaataaatgtaacggtactgacgcaaaagtgaaactaattaaacaagaactcgacaaatacaaaaatgctgtaacagacctacaaatgctaatgtgctcaacacccgcaaccggatcaggatcagccatagcctccggagtcgcagtatgcaaagtattacatcttgaaggagaagtaaataaaataaaatcagcattactatccacaaataaagccgtagtatcactatcaaacggtgtatccgtccttacattcaaagtattagatctaaaaaactacatagataaacaactactacccatcttaaacaaacaatcatgctcaattcccaacccagaaacagtcatggaatttcaacaaaaaaacaacagactcttagaaataacacgagaattttcagtaaacgcaggagtaaccacaccagtaagtacatacatgctcaccaactcagaattattatcacttattaacgacatgccaattacaaacgaccaaaaaaaattaatgtcaaacaatgtccaaattgttagacaacaatcatactctataatgtgtataataaaagaagaagtactagcttacgtagttcaattaccactatatggcgtaatagatacaccttgctggaaactacatacatctccattatgtacaactaacacaaaagaaggatctaacatatgcctaacacgcacagatcgaggatggtactgcgataatgcaggttccgtatcattctttccacaagcagaaacatgtaaagtatgctcaaacagagtattctgtgacactatgaactccttaaccctaccctcagaagtcaatctatgcaacgttgacatatttaacccaaaatacgactgtaaaatcatgacatctaaaacagacgtatcatcatcagttattacatccctaggagcaatagtatcttgctacggaaaaacaaaatgtacagcatccaacaaaaacaaaggaataatcaaaacattctcaaacggctgcgactacgtatcaaacaaaggtgtagacacagtatcagtaggaaatactttatattacgtaaataaacaagaaggacaatctctatacgttaaaggcgaacctattataaacttctacgacccactcgtattcccttcagacgaatttgacgcatctatatcccaagttaacgaaaaaatcaaccaatcattagcctttataagaaaatccgacgaattattacataacgtcaacgctggaaaatcaacaactaacataatgataaccacaataataatagtcatcatagttatattactaagtctaatagccgtaggcctcctactttattgcaaagcaagatcaacaccagtaacattatccaaagaccaactcagcggcataaacaatatagctttttcaaactagggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6128 - RNA, 1877 nt, synthetic construct
  misc_feature 1..1877: note = mRNA product Design b-2 comprising derived and/or modified sequence from HRSV(A2)__F_DSCav1_mut6 (opt11)
  source 1..1877: mol_type = other RNA
gggagagcctctgctggagtccggggagtggcgttggctgctagagcgaagcttaccatggaactcctcatcctcaaagccaacgcaatcacaaccatactaactgcagttactttctgcttcgcatccggccaaaacatcaccgaagagttctaccaatcaacctgctccgcagtctccaaaggatacctcggagcccttcgcaccggctggtacacctccgtcataaccatcgaactctcaaacataaaagaaaacaaatgcaacggcacagacgcgaaagtcaaacttatcaaacaagaactcgacaaatacaaaaacgccgtcaccgacctgcagatgctcatgtgctcaacccccgccacaggaagcggctctgctatcgcttccggcgtcgccgtctgcaaagtcctccacctcgaaggcgaagtaaacaaaatcaagtcagccctcctctccaccaacaaagccgtcgtctctctctcaaacggcgtatccgtcctcacattcaaagtcctcgacctcaaaaactacatcgacaaacaacttctccccatcctaaacaaacaatcatgctccatccccaaccccgaaacagtcatggaatttcaacaaaagaacaaccgcctcttagaaatcacccgagaattttccgtcaacgcgggagtcacaacccccgtttctacgtatatgctcaccaactccgaactcctttccctcataaacgacatgccaatcaccaacgaccaaaagaaactcatgtcaaacaacgtccaaatcgtccgacaacaatcctactctattatgtgcatcatcaaagaagaagttctcgcctacgtcgtccaactacccctctacggcgtgatcgacaccccctgctggaaactacacacctcacccctctgcaccaccaacaccaaggaaggctccaacatctgcctcacccgcaccgaccgcggctggtactgcgacaacgctggctccgtctcattcttcccgcaagccgaaacttgcaaagtatgctccaacagagtattctgcgacaccatgaactcactaaccctcccttccgaagtcaacctttgcaacgttgacatattcaacccaaagtacgattgcaaaattatgacatccaaaacagatgtctcctcctccgtcatcacatccctcggtgccattgtatcatgctacggaaaaaccaaatgcaccgcatccaacaaaaacaaaggaatcatcaaaaccttctcaaacggctgcgattacgtctcaaacaaaggagtcgacacagtctccgtcggaaacaccctatactacgtcaacaaacaagaaggccaatccctgtacgtcaaaggagaacccatcatcaacttctacgaccccctcgtcttcccgagcgacgagttcgacgcctccatctcacaagtcaatgaaaagatcaaccaatcccttgccttcatccggaaatcggacgaactcctacacaacgtgaacgctggaaaatcaaccaccaacatcatgatcacaaccatcattatcgtcatcatcgtcatactcctctccctaatcgccgtcggcctcctcctgtattgcaaagctcgctccacccccgtcaccctgtccaaagaccaactctccggaatcaacaacatcgccttctcaaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6129 - RNA, 1897 nt, synthetic construct
  misc_feature 1..1897: note = mRNA product Design b-3 comprising derived and/or modified sequence from HRSV(A2)__F_DSCav1_mut6 (opt1)
  source 1..1897: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaaccccgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6130 - RNA, 1897 nt, synthetic construct
  misc_feature 1..1897: note = mRNA product Design b-3 comprising derived and/or modified sequence from HRSV(A2)__F_DSCav1_mut6 (opt1)
  source 1..1897: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctcatgtgcagcacccccgccaccgggtccggcagcgccatcgcctccggcgtggcggtgtgcaaggtcctgcacctggagggggaggtgaacaagatcaagagcgccctcctgtccaccaacaaggccgtggtcagcctgtccaacggcgtgagcgtgctcacgttcaaggtcctggacctgaagaactacatcgacaagcagctcctgccgatcctgaacaagcagtcctgcagcatccccaaccccgagaccgtgatggagttccagcagaagaacaaccggctcctggagatcacccgcgagttctccgtgaacgccggggtcaccacgcccgtgagcacctacatgctgaccaactccgagctcctgagcctgatcaacgacatgccgatcaccaacgaccagaagaagctcatgagcaacaacgtgcagatcgtccggcagcagtcctacagcatcatgtgcatcatcaaggaggaggtgctggcctacgtggtccagctgcccctctacggcgtgatcgacacgccctgctggaagctgcacaccagccccctgtgcaccaccaacacgaaggaggggagcaacatctgcctcacccgcaccgaccggggctggtactgcgacaacgcgggctccgtgagcttcttcccgcaggccgagacctgcaaggtctgctccaaccgcgtgttctgcgacacgatgaacagcctgaccctgccctccgaggtcaacctctgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaacaaggggatcatcaagaccttctccaacggctgcgactacgtgagcaacaagggcgtcgacacggtgtccgtggggaacaccctgtactacgtcaacaagcaggagggccagagcctctacgtgaagggggagcccatcatcaacttctacgacccgctggtgttccccagcgacgagttcgacgcctccatcagccaggtcaacgagaagatcaaccagtccctggcgttcatccggaagtccgacgagctcctgcacaacgtgaacgccggcaagtccaccaccaacatcatgatcaccacgatcatcatcgtgatcatcgtcatcctgctcagcctgatcgccgtggggctgctcctgtactgcaaggcccgctccacccccgtgaccctgagcaaggaccagctgtccggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6131 - RNA, 1897 nt, synthetic construct
  misc_feature 1..1897: note = mRNA product Design b-3 comprising derived and/or modified sequence from HRSV(A2)__F_DSCav1_mut6 (opt2)
  source 1..1897: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6132 - RNA, 1897 nt, synthetic construct
  misc_feature 1..1897: note = mRNA product Design b-3 comprising derived and/or modified sequence from HRSV(A2)__F_DSCav1_mut6 (opt3)
  source 1..1897: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagatgcttatgtgttccacacccgccaccgggtctggatcggctatagcatcaggcgtggccgtctgcaaggtgctgcacttggagggtgaggttaacaaaatcaagagcgctctcctgagtacgaataaagccgtggtctccctgtctaacggggtgagcgtactcacttttaaggttttagatctgaagaattacattgacaaacagcttttgcctatcctgaacaagcaatcctgttcaattccaaatccggaaaccgtgatggagttccagcagaaaaacaataggctactcgaaatcacacgggagtttagtgtcaacgcgggagtgactacccccgtgagcacatatatgctgaccaattctgagcttctgtccttgataaacgatatgcctattacgaacgaccagaagaaactcatgtcaaataacgtccaaatcgttcgccagcagagctacagtattatgtgcatcatcaaggaagaggtgctggcatatgtagtgcagttaccactgtacggcgtcattgatactccctgttggaaactccatacatctcctctttgcaccactaatacaaaggaaggctccaacatatgtctgacccgaacggaccgtgggtggtactgcgataatgccggaagcgtgtcgttctttccacaagctgagacctgtaaggtttgctctaacagagtgttctgcgacacaatgaactccttgactctaccctcagaagtcaatctgtgtaatgtggatatctttaaccctaaatatgactgcaagattatgaccagtaaaacagatgtaagctcctctgttatcactagcctcggtgccatagtgtcatgttacggcaagaccaaatgcacagcaagtaataagaacaaggggattatcaaaaccttctccaatggatgtgactatgtcagcaacaagggcgtggacactgtctctgtgggtaatacgctgtactatgttaacaaacaggaggggcagtcactttacgtgaagggagagccaatcattaacttttatgatccgctggtattccccagtgacgaatttgatgctagcatctcccaagtcaatgagaaaattaaccagtctttggccttcataaggaagtcggacgaactcctgcacaatgtgaacgcgggcaagagcacaaccaatatcatgattactaccatcatcattgttataatcgtgattttactgtccctaatcgccgtcggcctcctgctttactgcaaagcacggtcaacacctgtgaccttgagtaaggatcagctgtctgggattaacaatatcgctttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6133 - RNA, 1897 nt, synthetic construct
  misc_feature 1..1897: note = mRNA product Design b-3 comprising derived and/or modified sequence from HRSV(A2)__F_DSCav1_mut6 (opt4)
  source 1..1897: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6134 - RNA, 1897 nt, synthetic construct
  misc_feature 1..1897: note = mRNA product Design b-3 comprising derived and/or modified sequence from HRSV(A2)__F_DSCav1_mut6 (opt5)
  source 1..1897: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagatgctgatgtgtagcacccccgccacaggatccggctctgctattgccagcggggtcgcggtgtgcaaggttctgcacctcgagggagaggtgaacaaaatcaagtccgccctgcttagcaccaataaagctgtcgtgtctctgtccaacggcgttagcgtgctcacatttaaggtcctggatcttaagaattacattgacaaacagctgctccctatcctgaacaagcaatcttgttccattccgaatcccgaaaccgtgatggagttccagcagaaaaacaatcggctgctcgaaatcacgcgcgagtttagcgtgaacgccggcgtcacaacccctgtttctacatatatgctgaccaattccgagcttctgagcctcattaacgatatgcccatcaccaacgaccagaagaaactgatgtccaataacgtgcaaatcgtgagacagcagtcttacagcattatgtgcatcattaaggaagaggtccttgcttatgtggttcagctgcctctctacggggtgatcgatacaccctgttggaaactgcatacgtcccctctgtgcaccacaaataccaaggaaggaagcaacatttgtctcacacggaccgaccgcggctggtactgcgataatgccgggtctgtctccttctttccgcaagcggagacgtgtaaggtgtgcagcaacagagttttctgcgacacaatgaactctctgacccttcccagcgaagtgaatctgtgtaatgtcgatatctttaaccctaaatatgactgcaagatcatgacctccaaaacagatgtgtctagctccgtcattaccagcctcggagccatcgtgtcttgttacggcaagacaaaatgcacggcttccaataagaacaaggggattatcaaaaccttcagcaatggatgtgactatgtttctaacaagggcgtggacacagtctccgtgggcaataccctgtactatgttaacaaacaggaggggcagagcctttacgtgaagggagagcccattatcaacttttatgatcctctggtcttcccctccgacgaatttgatgcctctatcagccaagtgaatgagaaaattaaccagtccctcgctttcatccggaagtctgacgaactgctgcacaatgtgaacgccggcaagagcacaaccaatattatgatcacgaccattatcattgttatcatcgtcattctcctgtcccttatcgccgtggggctgctcctgtactgcaaagctcgcagcacaccggtgaccctgtctaaggatcagctttccggaattaacaatatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6135 - RNA, 1897 nt, synthetic construct
  misc_feature 1..1897: note = mRNA product Design b-3 comprising derived and/or modified sequence from HRSV(A2)__F_DSCav1_mut6 (opt6)
  source 1..1897: mol_type = other RNA
gggagagtcccgcagtcggcgtccagcggctctgcttgttcgtgtgtgtgtcgttgcaggccttattcaagcttaccatggaactattaatcttaaaagcaaatgctataaccacaatattaacagcagtaacattctgttttgcctccggacaaaacataacagaagaattttatcaatcaacatgctctgcagtatccaaaggttacttaggcgcactacgcactggatggtatacatcagtaataacaatagaactatcaaacataaaagaaaataaatgtaacggtactgacgcaaaagtgaaactaattaaacaagaactcgacaaatacaaaaatgctgtaacagacctacaaatgctaatgtgctcaacacccgcaaccggatcaggatcagccatagcctccggagtcgcagtatgcaaagtattacatcttgaaggagaagtaaataaaataaaatcagcattactatccacaaataaagccgtagtatcactatcaaacggtgtatccgtccttacattcaaagtattagatctaaaaaactacatagataaacaactactacccatcttaaacaaacaatcatgctcaattcccaacccagaaacagtcatggaatttcaacaaaaaaacaacagactcttagaaataacacgagaattttcagtaaacgcaggagtaaccacaccagtaagtacatacatgctcaccaactcagaattattatcacttattaacgacatgccaattacaaacgaccaaaaaaaattaatgtcaaacaatgtccaaattgttagacaacaatcatactctataatgtgtataataaaagaagaagtactagcttacgtagttcaattaccactatatggcgtaatagatacaccttgctggaaactacatacatctccattatgtacaactaacacaaaagaaggatctaacatatgcctaacacgcacagatcgaggatggtactgcgataatgcaggttccgtatcattctttccacaagcagaaacatgtaaagtatgctcaaacagagtattctgtgacactatgaactccttaaccctaccctcagaagtcaatctatgcaacgttgacatatttaacccaaaatacgactgtaaaatcatgacatctaaaacagacgtatcatcatcagttattacatccctaggagcaatagtatcttgctacggaaaaacaaaatgtacagcatccaacaaaaacaaaggaataatcaaaacattctcaaacggctgcgactacgtatcaaacaaaggtgtagacacagtatcagtaggaaatactttatattacgtaaataaacaagaaggacaatctctatacgttaaaggcgaacctattataaacttctacgacccactcgtattcccttcagacgaatttgacgcatctatatcccaagttaacgaaaaaatcaaccaatcattagcctttataagaaaatccgacgaattattacataacgtcaacgctggaaaatcaacaactaacataatgataaccacaataataatagtcatcatagttatattactaagtctaatagccgtaggcctcctactttattgcaaagcaagatcaacaccagtaacattatccaaagaccaactcagcggcataaacaatatagctttttcaaactagggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6136 - RNA, 1897 nt, synthetic construct
  misc_feature 1..1897: note = mRNA product Design b-3 comprising derived and/or modified sequence from HRSV(A2)__F_DSCav1_mut6 (opt11)
  source 1..1897: mol_type = other RNA
gggagagtcccgcagtcggcgtccagcggctctgcttgttcgtgtgtgtgtcgttgcaggccttattcaagcttaccatggaactcctcatcctcaaagccaacgcaatcacaaccatactaactgcagttactttctgcttcgcatccggccaaaacatcaccgaagagttctaccaatcaacctgctccgcagtctccaaaggatacctcggagcccttcgcaccggctggtacacctccgtcataaccatcgaactctcaaacataaaagaaaacaaatgcaacggcacagacgcgaaagtcaaacttatcaaacaagaactcgacaaatacaaaaacgccgtcaccgacctgcagatgctcatgtgctcaacccccgccacaggaagcggctctgctatcgcttccggcgtcgccgtctgcaaagtcctccacctcgaaggcgaagtaaacaaaatcaagtcagccctcctctccaccaacaaagccgtcgtctctctctcaaacggcgtatccgtcctcacattcaaagtcctcgacctcaaaaactacatcgacaaacaacttctccccatcctaaacaaacaatcatgctccatccccaaccccgaaacagtcatggaatttcaacaaaagaacaaccgcctcttagaaatcacccgagaattttccgtcaacgcgggagtcacaacccccgtttctacgtatatgctcaccaactccgaactcctttccctcataaacgacatgccaatcaccaacgaccaaaagaaactcatgtcaaacaacgtccaaatcgtccgacaacaatcctactctattatgtgcatcatcaaagaagaagttctcgcctacgtcgtccaactacccctctacggcgtgatcgacaccccctgctggaaactacacacctcacccctctgcaccaccaacaccaaggaaggctccaacatctgcctcacccgcaccgaccgcggctggtactgcgacaacgctggctccgtctcattcttcccgcaagccgaaacttgcaaagtatgctccaacagagtattctgcgacaccatgaactcactaaccctcccttccgaagtcaacctttgcaacgttgacatattcaacccaaagtacgattgcaaaattatgacatccaaaacagatgtctcctcctccgtcatcacatccctcggtgccattgtatcatgctacggaaaaaccaaatgcaccgcatccaacaaaaacaaaggaatcatcaaaaccttctcaaacggctgcgattacgtctcaaacaaaggagtcgacacagtctccgtcggaaacaccctatactacgtcaacaaacaagaaggccaatccctgtacgtcaaaggagaacccatcatcaacttctacgaccccctcgtcttcccgagcgacgagttcgacgcctccatctcacaagtcaatgaaaagatcaaccaatcccttgccttcatccggaaatcggacgaactcctacacaacgtgaacgctggaaaatcaaccaccaacatcatgatcacaaccatcattatcgtcatcatcgtcatactcctctccctaatcgccgtcggcctcctcctgtattgcaaagctcgctccacccccgtcaccctgtccaaagaccaactctccggaatcaacaacatcgccttctcaaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6137 - RNA, 1948 nt, synthetic construct
  misc_feature 1..1948: note = mRNA product Design b-4 comprising derived and/or modified sequence from HRSV(A2)__F_DSCav1_mut6 (opt1)
  source 1..1948: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaaccccgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6138 - RNA, 1948 nt, synthetic construct
  misc_feature 1..1948: note = mRNA product Design b-4 comprising derived and/or modified sequence from HRSV(A2)__F_DSCav1_mut6 (opt1)
  source 1..1948: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctcatgtgcagcacccccgccaccgggtccggcagcgccatcgcctccggcgtggcggtgtgcaaggtcctgcacctggagggggaggtgaacaagatcaagagcgccctcctgtccaccaacaaggccgtggtcagcctgtccaacggcgtgagcgtgctcacgttcaaggtcctggacctgaagaactacatcgacaagcagctcctgccgatcctgaacaagcagtcctgcagcatccccaaccccgagaccgtgatggagttccagcagaagaacaaccggctcctggagatcacccgcgagttctccgtgaacgccggggtcaccacgcccgtgagcacctacatgctgaccaactccgagctcctgagcctgatcaacgacatgccgatcaccaacgaccagaagaagctcatgagcaacaacgtgcagatcgtccggcagcagtcctacagcatcatgtgcatcatcaaggaggaggtgctggcctacgtggtccagctgcccctctacggcgtgatcgacacgccctgctggaagctgcacaccagccccctgtgcaccaccaacacgaaggaggggagcaacatctgcctcacccgcaccgaccggggctggtactgcgacaacgcgggctccgtgagcttcttcccgcaggccgagacctgcaaggtctgctccaaccgcgtgttctgcgacacgatgaacagcctgaccctgccctccgaggtcaacctctgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaacaaggggatcatcaagaccttctccaacggctgcgactacgtgagcaacaagggcgtcgacacggtgtccgtggggaacaccctgtactacgtcaacaagcaggagggccagagcctctacgtgaagggggagcccatcatcaacttctacgacccgctggtgttccccagcgacgagttcgacgcctccatcagccaggtcaacgagaagatcaaccagtccctggcgttcatccggaagtccgacgagctcctgcacaacgtgaacgccggcaagtccaccaccaacatcatgatcaccacgatcatcatcgtgatcatcgtcatcctgctcagcctgatcgccgtggggctgctcctgtactgcaaggcccgctccacccccgtgaccctgagcaaggaccagctgtccggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6139 - RNA, 1948 nt, synthetic construct
  misc_feature 1..1948: note = mRNA product Design b-4 comprising derived and/or modified sequence from HRSV(A2)__F_DSCav1_mut6 (opt2)
  source 1..1948: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6140 - RNA, 1948 nt, synthetic construct
  misc_feature 1..1948: note = mRNA product Design b-4 comprising derived and/or modified sequence from HRSV(A2)__F_DSCav1_mut6 (opt3)
  source 1..1948: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagatgcttatgtgttccacacccgccaccgggtctggatcggctatagcatcaggcgtggccgtctgcaaggtgctgcacttggagggtgaggttaacaaaatcaagagcgctctcctgagtacgaataaagccgtggtctccctgtctaacggggtgagcgtactcacttttaaggttttagatctgaagaattacattgacaaacagcttttgcctatcctgaacaagcaatcctgttcaattccaaatccggaaaccgtgatggagttccagcagaaaaacaataggctactcgaaatcacacgggagtttagtgtcaacgcgggagtgactacccccgtgagcacatatatgctgaccaattctgagcttctgtccttgataaacgatatgcctattacgaacgaccagaagaaactcatgtcaaataacgtccaaatcgttcgccagcagagctacagtattatgtgcatcatcaaggaagaggtgctggcatatgtagtgcagttaccactgtacggcgtcattgatactccctgttggaaactccatacatctcctctttgcaccactaatacaaaggaaggctccaacatatgtctgacccgaacggaccgtgggtggtactgcgataatgccggaagcgtgtcgttctttccacaagctgagacctgtaaggtttgctctaacagagtgttctgcgacacaatgaactccttgactctaccctcagaagtcaatctgtgtaatgtggatatctttaaccctaaatatgactgcaagattatgaccagtaaaacagatgtaagctcctctgttatcactagcctcggtgccatagtgtcatgttacggcaagaccaaatgcacagcaagtaataagaacaaggggattatcaaaaccttctccaatggatgtgactatgtcagcaacaagggcgtggacactgtctctgtgggtaatacgctgtactatgttaacaaacaggaggggcagtcactttacgtgaagggagagccaatcattaacttttatgatccgctggtattccccagtgacgaatttgatgctagcatctcccaagtcaatgagaaaattaaccagtctttggccttcataaggaagtcggacgaactcctgcacaatgtgaacgcgggcaagagcacaaccaatatcatgattactaccatcatcattgttataatcgtgattttactgtccctaatcgccgtcggcctcctgctttactgcaaagcacggtcaacacctgtgaccttgagtaaggatcagctgtctgggattaacaatatcgctttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6141 - RNA, 1948 nt, synthetic construct
  misc_feature 1..1948: note = mRNA product Design b-4 comprising derived and/or modified sequence from HRSV(A2)__F_DSCav1_mut6 (opt4)
  source 1..1948: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6142 - RNA, 1948 nt, synthetic construct
  misc_feature 1..1948: note = mRNA product Design b-4 comprising derived and/or modified sequence from HRSV(A2)__F_DSCav1_mut6 (opt5)
  source 1..1948: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagatgctgatgtgtagcacccccgccacaggatccggctctgctattgccagcggggtcgcggtgtgcaaggttctgcacctcgagggagaggtgaacaaaatcaagtccgccctgcttagcaccaataaagctgtcgtgtctctgtccaacggcgttagcgtgctcacatttaaggtcctggatcttaagaattacattgacaaacagctgctccctatcctgaacaagcaatcttgttccattccgaatcccgaaaccgtgatggagttccagcagaaaaacaatcggctgctcgaaatcacgcgcgagtttagcgtgaacgccggcgtcacaacccctgtttctacatatatgctgaccaattccgagcttctgagcctcattaacgatatgcccatcaccaacgaccagaagaaactgatgtccaataacgtgcaaatcgtgagacagcagtcttacagcattatgtgcatcattaaggaagaggtccttgcttatgtggttcagctgcctctctacggggtgatcgatacaccctgttggaaactgcatacgtcccctctgtgcaccacaaataccaaggaaggaagcaacatttgtctcacacggaccgaccgcggctggtactgcgataatgccgggtctgtctccttctttccgcaagcggagacgtgtaaggtgtgcagcaacagagttttctgcgacacaatgaactctctgacccttcccagcgaagtgaatctgtgtaatgtcgatatctttaaccctaaatatgactgcaagatcatgacctccaaaacagatgtgtctagctccgtcattaccagcctcggagccatcgtgtcttgttacggcaagacaaaatgcacggcttccaataagaacaaggggattatcaaaaccttcagcaatggatgtgactatgtttctaacaagggcgtggacacagtctccgtgggcaataccctgtactatgttaacaaacaggaggggcagagcctttacgtgaagggagagcccattatcaacttttatgatcctctggtcttcccctccgacgaatttgatgcctctatcagccaagtgaatgagaaaattaaccagtccctcgctttcatccggaagtctgacgaactgctgcacaatgtgaacgccggcaagagcacaaccaatattatgatcacgaccattatcattgttatcatcgtcattctcctgtcccttatcgccgtggggctgctcctgtactgcaaagctcgcagcacaccggtgaccctgtctaaggatcagctttccggaattaacaatatcgcgttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6143 - RNA, 1948 nt, synthetic construct
  misc_feature 1..1948: note = mRNA product Design b-4 comprising derived and/or modified sequence from HRSV(A2)__F_DSCav1_mut6 (opt6)
  source 1..1948: mol_type = other RNA
gggagagtcccgcagtcggcgtccagcggctctgcttgttcgtgtgtgtgtcgttgcaggccttattcaagcttaccatggaactattaatcttaaaagcaaatgctataaccacaatattaacagcagtaacattctgttttgcctccggacaaaacataacagaagaattttatcaatcaacatgctctgcagtatccaaaggttacttaggcgcactacgcactggatggtatacatcagtaataacaatagaactatcaaacataaaagaaaataaatgtaacggtactgacgcaaaagtgaaactaattaaacaagaactcgacaaatacaaaaatgctgtaacagacctacaaatgctaatgtgctcaacacccgcaaccggatcaggatcagccatagcctccggagtcgcagtatgcaaagtattacatcttgaaggagaagtaaataaaataaaatcagcattactatccacaaataaagccgtagtatcactatcaaacggtgtatccgtccttacattcaaagtattagatctaaaaaactacatagataaacaactactacccatcttaaacaaacaatcatgctcaattcccaacccagaaacagtcatggaatttcaacaaaaaaacaacagactcttagaaataacacgagaattttcagtaaacgcaggagtaaccacaccagtaagtacatacatgctcaccaactcagaattattatcacttattaacgacatgccaattacaaacgaccaaaaaaaattaatgtcaaacaatgtccaaattgttagacaacaatcatactctataatgtgtataataaaagaagaagtactagcttacgtagttcaattaccactatatggcgtaatagatacaccttgctggaaactacatacatctccattatgtacaactaacacaaaagaaggatctaacatatgcctaacacgcacagatcgaggatggtactgcgataatgcaggttccgtatcattctttccacaagcagaaacatgtaaagtatgctcaaacagagtattctgtgacactatgaactccttaaccctaccctcagaagtcaatctatgcaacgttgacatatttaacccaaaatacgactgtaaaatcatgacatctaaaacagacgtatcatcatcagttattacatccctaggagcaatagtatcttgctacggaaaaacaaaatgtacagcatccaacaaaaacaaaggaataatcaaaacattctcaaacggctgcgactacgtatcaaacaaaggtgtagacacagtatcagtaggaaatactttatattacgtaaataaacaagaaggacaatctctatacgttaaaggcgaacctattataaacttctacgacccactcgtattcccttcagacgaatttgacgcatctatatcccaagttaacgaaaaaatcaaccaatcattagcctttataagaaaatccgacgaattattacataacgtcaacgctggaaaatcaacaactaacataatgataaccacaataataatagtcatcatagttatattactaagtctaatagccgtaggcctcctactttattgcaaagcaagatcaacaccagtaacattatccaaagaccaactcagcggcataaacaatatagctttttcaaactagggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6144 - RNA, 1948 nt, synthetic construct
  misc_feature 1..1948: note = mRNA product Design b-4 comprising derived and/or modified sequence from HRSV(A2)__F_DSCav1_mut6 (opt11)
  source 1..1948: mol_type = other RNA
gggagagtcccgcagtcggcgtccagcggctctgcttgttcgtgtgtgtgtcgttgcaggccttattcaagcttaccatggaactcctcatcctcaaagccaacgcaatcacaaccatactaactgcagttactttctgcttcgcatccggccaaaacatcaccgaagagttctaccaatcaacctgctccgcagtctccaaaggatacctcggagcccttcgcaccggctggtacacctccgtcataaccatcgaactctcaaacataaaagaaaacaaatgcaacggcacagacgcgaaagtcaaacttatcaaacaagaactcgacaaatacaaaaacgccgtcaccgacctgcagatgctcatgtgctcaacccccgccacaggaagcggctctgctatcgcttccggcgtcgccgtctgcaaagtcctccacctcgaaggcgaagtaaacaaaatcaagtcagccctcctctccaccaacaaagccgtcgtctctctctcaaacggcgtatccgtcctcacattcaaagtcctcgacctcaaaaactacatcgacaaacaacttctccccatcctaaacaaacaatcatgctccatccccaaccccgaaacagtcatggaatttcaacaaaagaacaaccgcctcttagaaatcacccgagaattttccgtcaacgcgggagtcacaacccccgtttctacgtatatgctcaccaactccgaactcctttccctcataaacgacatgccaatcaccaacgaccaaaagaaactcatgtcaaacaacgtccaaatcgtccgacaacaatcctactctattatgtgcatcatcaaagaagaagttctcgcctacgtcgtccaactacccctctacggcgtgatcgacaccccctgctggaaactacacacctcacccctctgcaccaccaacaccaaggaaggctccaacatctgcctcacccgcaccgaccgcggctggtactgcgacaacgctggctccgtctcattcttcccgcaagccgaaacttgcaaagtatgctccaacagagtattctgcgacaccatgaactcactaaccctcccttccgaagtcaacctttgcaacgttgacatattcaacccaaagtacgattgcaaaattatgacatccaaaacagatgtctcctcctccgtcatcacatccctcggtgccattgtatcatgctacggaaaaaccaaatgcaccgcatccaacaaaaacaaaggaatcatcaaaaccttctcaaacggctgcgattacgtctcaaacaaaggagtcgacacagtctccgtcggaaacaccctatactacgtcaacaaacaagaaggccaatccctgtacgtcaaaggagaacccatcatcaacttctacgaccccctcgtcttcccgagcgacgagttcgacgcctccatctcacaagtcaatgaaaagatcaaccaatcccttgccttcatccggaaatcggacgaactcctacacaacgtgaacgctggaaaatcaaccaccaacatcatgatcacaaccatcattatcgtcatcatcgtcatactcctctccctaatcgccgtcggcctcctcctgtattgcaaagctcgctccacccccgtcaccctgtccaaagaccaactctccggaatcaacaacatcgccttctcaaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6145 - RNA, 2010 nt, synthetic construct
  misc_feature 1..2010: note = mRNA product Design b-5 comprising derived and/or modified sequence from HRSV(A2)__F_DSCav1_mut6 (opt1)
  source 1..2010: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaaccccgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6146 - RNA, 2010 nt, synthetic construct
  misc_feature 1..2010: note = mRNA product Design b-5 comprising derived and/or modified sequence from HRSV(A2)__F_DSCav1_mut6 (opt1)
  source 1..2010: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctcatgtgcagcacccccgccaccgggtccggcagcgccatcgcctccggcgtggcggtgtgcaaggtcctgcacctggagggggaggtgaacaagatcaagagcgccctcctgtccaccaacaaggccgtggtcagcctgtccaacggcgtgagcgtgctcacgttcaaggtcctggacctgaagaactacatcgacaagcagctcctgccgatcctgaacaagcagtcctgcagcatccccaaccccgagaccgtgatggagttccagcagaagaacaaccggctcctggagatcacccgcgagttctccgtgaacgccggggtcaccacgcccgtgagcacctacatgctgaccaactccgagctcctgagcctgatcaacgacatgccgatcaccaacgaccagaagaagctcatgagcaacaacgtgcagatcgtccggcagcagtcctacagcatcatgtgcatcatcaaggaggaggtgctggcctacgtggtccagctgcccctctacggcgtgatcgacacgccctgctggaagctgcacaccagccccctgtgcaccaccaacacgaaggaggggagcaacatctgcctcacccgcaccgaccggggctggtactgcgacaacgcgggctccgtgagcttcttcccgcaggccgagacctgcaaggtctgctccaaccgcgtgttctgcgacacgatgaacagcctgaccctgccctccgaggtcaacctctgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaacaaggggatcatcaagaccttctccaacggctgcgactacgtgagcaacaagggcgtcgacacggtgtccgtggggaacaccctgtactacgtcaacaagcaggagggccagagcctctacgtgaagggggagcccatcatcaacttctacgacccgctggtgttccccagcgacgagttcgacgcctccatcagccaggtcaacgagaagatcaaccagtccctggcgttcatccggaagtccgacgagctcctgcacaacgtgaacgccggcaagtccaccaccaacatcatgatcaccacgatcatcatcgtgatcatcgtcatcctgctcagcctgatcgccgtggggctgctcctgtactgcaaggcccgctccacccccgtgaccctgagcaaggaccagctgtccggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6147 - RNA, 2010 nt, synthetic construct
  misc_feature 1..2010: note = mRNA product Design b-5 comprising derived and/or modified sequence from HRSV(A2)__F_DSCav1_mut6 (opt2)
  source 1..2010: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6148 - RNA, 2010 nt, synthetic construct
  misc_feature 1..2010: note = mRNA product Design b-5 comprising derived and/or modified sequence from HRSV(A2)__F_DSCav1_mut6 (opt3)
  source 1..2010: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagatgcttatgtgttccacacccgccaccgggtctggatcggctatagcatcaggcgtggccgtctgcaaggtgctgcacttggagggtgaggttaacaaaatcaagagcgctctcctgagtacgaataaagccgtggtctccctgtctaacggggtgagcgtactcacttttaaggttttagatctgaagaattacattgacaaacagcttttgcctatcctgaacaagcaatcctgttcaattccaaatccggaaaccgtgatggagttccagcagaaaaacaataggctactcgaaatcacacgggagtttagtgtcaacgcgggagtgactacccccgtgagcacatatatgctgaccaattctgagcttctgtccttgataaacgatatgcctattacgaacgaccagaagaaactcatgtcaaataacgtccaaatcgttcgccagcagagctacagtattatgtgcatcatcaaggaagaggtgctggcatatgtagtgcagttaccactgtacggcgtcattgatactccctgttggaaactccatacatctcctctttgcaccactaatacaaaggaaggctccaacatatgtctgacccgaacggaccgtgggtggtactgcgataatgccggaagcgtgtcgttctttccacaagctgagacctgtaaggtttgctctaacagagtgttctgcgacacaatgaactccttgactctaccctcagaagtcaatctgtgtaatgtggatatctttaaccctaaatatgactgcaagattatgaccagtaaaacagatgtaagctcctctgttatcactagcctcggtgccatagtgtcatgttacggcaagaccaaatgcacagcaagtaataagaacaaggggattatcaaaaccttctccaatggatgtgactatgtcagcaacaagggcgtggacactgtctctgtgggtaatacgctgtactatgttaacaaacaggaggggcagtcactttacgtgaagggagagccaatcattaacttttatgatccgctggtattccccagtgacgaatttgatgctagcatctcccaagtcaatgagaaaattaaccagtctttggccttcataaggaagtcggacgaactcctgcacaatgtgaacgcgggcaagagcacaaccaatatcatgattactaccatcatcattgttataatcgtgattttactgtccctaatcgccgtcggcctcctgctttactgcaaagcacggtcaacacctgtgaccttgagtaaggatcagctgtctgggattaacaatatcgctttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6149 - RNA, 2010 nt, synthetic construct
  misc_feature 1..2010: note = mRNA product Design b-5 comprising derived and/or modified sequence from HRSV(A2)__F_DSCav1_mut6 (opt4)
  source 1..2010: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6150 - RNA, 2010 nt, synthetic construct
  misc_feature 1..2010: note = mRNA product Design b-5 comprising derived and/or modified sequence from HRSV(A2)__F_DSCav1_mut6 (opt5)
  source 1..2010: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagatgctgatgtgtagcacccccgccacaggatccggctctgctattgccagcggggtcgcggtgtgcaaggttctgcacctcgagggagaggtgaacaaaatcaagtccgccctgcttagcaccaataaagctgtcgtgtctctgtccaacggcgttagcgtgctcacatttaaggtcctggatcttaagaattacattgacaaacagctgctccctatcctgaacaagcaatcttgttccattccgaatcccgaaaccgtgatggagttccagcagaaaaacaatcggctgctcgaaatcacgcgcgagtttagcgtgaacgccggcgtcacaacccctgtttctacatatatgctgaccaattccgagcttctgagcctcattaacgatatgcccatcaccaacgaccagaagaaactgatgtccaataacgtgcaaatcgtgagacagcagtcttacagcattatgtgcatcattaaggaagaggtccttgcttatgtggttcagctgcctctctacggggtgatcgatacaccctgttggaaactgcatacgtcccctctgtgcaccacaaataccaaggaaggaagcaacatttgtctcacacggaccgaccgcggctggtactgcgataatgccgggtctgtctccttctttccgcaagcggagacgtgtaaggtgtgcagcaacagagttttctgcgacacaatgaactctctgacccttcccagcgaagtgaatctgtgtaatgtcgatatctttaaccctaaatatgactgcaagatcatgacctccaaaacagatgtgtctagctccgtcattaccagcctcggagccatcgtgtcttgttacggcaagacaaaatgcacggcttccaataagaacaaggggattatcaaaaccttcagcaatggatgtgactatgtttctaacaagggcgtggacacagtctccgtgggcaataccctgtactatgttaacaaacaggaggggcagagcctttacgtgaagggagagcccattatcaacttttatgatcctctggtcttcccctccgacgaatttgatgcctctatcagccaagtgaatgagaaaattaaccagtccctcgctttcatccggaagtctgacgaactgctgcacaatgtgaacgccggcaagagcacaaccaatattatgatcacgaccattatcattgttatcatcgtcattctcctgtcccttatcgccgtggggctgctcctgtactgcaaagctcgcagcacaccggtgaccctgtctaaggatcagctttccggaattaacaatatcgcgttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6151 - RNA, 2010 nt, synthetic construct
  misc_feature 1..2010: note = mRNA product Design b-5 comprising derived and/or modified sequence from HRSV(A2)__F_DSCav1_mut6 (opt6)
  source 1..2010: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactattaatcttaaaagcaaatgctataaccacaatattaacagcagtaacattctgttttgcctccggacaaaacataacagaagaattttatcaatcaacatgctctgcagtatccaaaggttacttaggcgcactacgcactggatggtatacatcagtaataacaatagaactatcaaacataaaagaaaataaatgtaacggtactgacgcaaaagtgaaactaattaaacaagaactcgacaaatacaaaaatgctgtaacagacctacaaatgctaatgtgctcaacacccgcaaccggatcaggatcagccatagcctccggagtcgcagtatgcaaagtattacatcttgaaggagaagtaaataaaataaaatcagcattactatccacaaataaagccgtagtatcactatcaaacggtgtatccgtccttacattcaaagtattagatctaaaaaactacatagataaacaactactacccatcttaaacaaacaatcatgctcaattcccaacccagaaacagtcatggaatttcaacaaaaaaacaacagactcttagaaataacacgagaattttcagtaaacgcaggagtaaccacaccagtaagtacatacatgctcaccaactcagaattattatcacttattaacgacatgccaattacaaacgaccaaaaaaaattaatgtcaaacaatgtccaaattgttagacaacaatcatactctataatgtgtataataaaagaagaagtactagcttacgtagttcaattaccactatatggcgtaatagatacaccttgctggaaactacatacatctccattatgtacaactaacacaaaagaaggatctaacatatgcctaacacgcacagatcgaggatggtactgcgataatgcaggttccgtatcattctttccacaagcagaaacatgtaaagtatgctcaaacagagtattctgtgacactatgaactccttaaccctaccctcagaagtcaatctatgcaacgttgacatatttaacccaaaatacgactgtaaaatcatgacatctaaaacagacgtatcatcatcagttattacatccctaggagcaatagtatcttgctacggaaaaacaaaatgtacagcatccaacaaaaacaaaggaataatcaaaacattctcaaacggctgcgactacgtatcaaacaaaggtgtagacacagtatcagtaggaaatactttatattacgtaaataaacaagaaggacaatctctatacgttaaaggcgaacctattataaacttctacgacccactcgtattcccttcagacgaatttgacgcatctatatcccaagttaacgaaaaaatcaaccaatcattagcctttataagaaaatccgacgaattattacataacgtcaacgctggaaaatcaacaactaacataatgataaccacaataataatagtcatcatagttatattactaagtctaatagccgtaggcctcctactttattgcaaagcaagatcaacaccagtaacattatccaaagaccaactcagcggcataaacaatatagctttttcaaactagggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6152 - RNA, 2010 nt, synthetic construct
  misc_feature 1..2010: note = mRNA product Design b-5 comprising derived and/or modified sequence from HRSV(A2)__F_DSCav1_mut6 (opt11)
  source 1..2010: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactcctcatcctcaaagccaacgcaatcacaaccatactaactgcagttactttctgcttcgcatccggccaaaacatcaccgaagagttctaccaatcaacctgctccgcagtctccaaaggatacctcggagcccttcgcaccggctggtacacctccgtcataaccatcgaactctcaaacataaaagaaaacaaatgcaacggcacagacgcgaaagtcaaacttatcaaacaagaactcgacaaatacaaaaacgccgtcaccgacctgcagatgctcatgtgctcaacccccgccacaggaagcggctctgctatcgcttccggcgtcgccgtctgcaaagtcctccacctcgaaggcgaagtaaacaaaatcaagtcagccctcctctccaccaacaaagccgtcgtctctctctcaaacggcgtatccgtcctcacattcaaagtcctcgacctcaaaaactacatcgacaaacaacttctccccatcctaaacaaacaatcatgctccatccccaaccccgaaacagtcatggaatttcaacaaaagaacaaccgcctcttagaaatcacccgagaattttccgtcaacgcgggagtcacaacccccgtttctacgtatatgctcaccaactccgaactcctttccctcataaacgacatgccaatcaccaacgaccaaaagaaactcatgtcaaacaacgtccaaatcgtccgacaacaatcctactctattatgtgcatcatcaaagaagaagttctcgcctacgtcgtccaactacccctctacggcgtgatcgacaccccctgctggaaactacacacctcacccctctgcaccaccaacaccaaggaaggctccaacatctgcctcacccgcaccgaccgcggctggtactgcgacaacgctggctccgtctcattcttcccgcaagccgaaacttgcaaagtatgctccaacagagtattctgcgacaccatgaactcactaaccctcccttccgaagtcaacctttgcaacgttgacatattcaacccaaagtacgattgcaaaattatgacatccaaaacagatgtctcctcctccgtcatcacatccctcggtgccattgtatcatgctacggaaaaaccaaatgcaccgcatccaacaaaaacaaaggaatcatcaaaaccttctcaaacggctgcgattacgtctcaaacaaaggagtcgacacagtctccgtcggaaacaccctatactacgtcaacaaacaagaaggccaatccctgtacgtcaaaggagaacccatcatcaacttctacgaccccctcgtcttcccgagcgacgagttcgacgcctccatctcacaagtcaatgaaaagatcaaccaatcccttgccttcatccggaaatcggacgaactcctacacaacgtgaacgctggaaaatcaaccaccaacatcatgatcacaaccatcattatcgtcatcatcgtcatactcctctccctaatcgccgtcggcctcctcctgtattgcaaagctcgctccacccccgtcaccctgtccaaagaccaactctccggaatcaacaacatcgccttctcaaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6153 - RNA, 1916 nt, synthetic construct
  misc_feature 1..1916: note = mRNA product Design c-1 comprising derived and/or modified sequence from HRSV(A2)__F_DSCav1_mut6 (opt1)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaaccccgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6154 - RNA, 1916 nt, synthetic construct
  misc_feature 1..1916: note = mRNA product Design c-1 comprising derived and/or modified sequence from HRSV(A2)__F_DSCav1_mut6 (opt1)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctcatgtgcagcacccccgccaccgggtccggcagcgccatcgcctccggcgtggcggtgtgcaaggtcctgcacctggagggggaggtgaacaagatcaagagcgccctcctgtccaccaacaaggccgtggtcagcctgtccaacggcgtgagcgtgctcacgttcaaggtcctggacctgaagaactacatcgacaagcagctcctgccgatcctgaacaagcagtcctgcagcatccccaaccccgagaccgtgatggagttccagcagaagaacaaccggctcctggagatcacccgcgagttctccgtgaacgccggggtcaccacgcccgtgagcacctacatgctgaccaactccgagctcctgagcctgatcaacgacatgccgatcaccaacgaccagaagaagctcatgagcaacaacgtgcagatcgtccggcagcagtcctacagcatcatgtgcatcatcaaggaggaggtgctggcctacgtggtccagctgcccctctacggcgtgatcgacacgccctgctggaagctgcacaccagccccctgtgcaccaccaacacgaaggaggggagcaacatctgcctcacccgcaccgaccggggctggtactgcgacaacgcgggctccgtgagcttcttcccgcaggccgagacctgcaaggtctgctccaaccgcgtgttctgcgacacgatgaacagcctgaccctgccctccgaggtcaacctctgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaacaaggggatcatcaagaccttctccaacggctgcgactacgtgagcaacaagggcgtcgacacggtgtccgtggggaacaccctgtactacgtcaacaagcaggagggccagagcctctacgtgaagggggagcccatcatcaacttctacgacccgctggtgttccccagcgacgagttcgacgcctccatcagccaggtcaacgagaagatcaaccagtccctggcgttcatccggaagtccgacgagctcctgcacaacgtgaacgccggcaagtccaccaccaacatcatgatcaccacgatcatcatcgtgatcatcgtcatcctgctcagcctgatcgccgtggggctgctcctgtactgcaaggcccgctccacccccgtgaccctgagcaaggaccagctgtccggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6155 - RNA, 1916 nt, synthetic construct
  misc_feature 1..1916: note = mRNA product Design c-1 comprising derived and/or modified sequence from HRSV(A2)__F_DSCav1_mut6 (opt2)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6156 - RNA, 1916 nt, synthetic construct
  misc_feature 1..1916: note = mRNA product Design c-1 comprising derived and/or modified sequence from HRSV(A2)__F_DSCav1_mut6 (opt3)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagatgcttatgtgttccacacccgccaccgggtctggatcggctatagcatcaggcgtggccgtctgcaaggtgctgcacttggagggtgaggttaacaaaatcaagagcgctctcctgagtacgaataaagccgtggtctccctgtctaacggggtgagcgtactcacttttaaggttttagatctgaagaattacattgacaaacagcttttgcctatcctgaacaagcaatcctgttcaattccaaatccggaaaccgtgatggagttccagcagaaaaacaataggctactcgaaatcacacgggagtttagtgtcaacgcgggagtgactacccccgtgagcacatatatgctgaccaattctgagcttctgtccttgataaacgatatgcctattacgaacgaccagaagaaactcatgtcaaataacgtccaaatcgttcgccagcagagctacagtattatgtgcatcatcaaggaagaggtgctggcatatgtagtgcagttaccactgtacggcgtcattgatactccctgttggaaactccatacatctcctctttgcaccactaatacaaaggaaggctccaacatatgtctgacccgaacggaccgtgggtggtactgcgataatgccggaagcgtgtcgttctttccacaagctgagacctgtaaggtttgctctaacagagtgttctgcgacacaatgaactccttgactctaccctcagaagtcaatctgtgtaatgtggatatctttaaccctaaatatgactgcaagattatgaccagtaaaacagatgtaagctcctctgttatcactagcctcggtgccatagtgtcatgttacggcaagaccaaatgcacagcaagtaataagaacaaggggattatcaaaaccttctccaatggatgtgactatgtcagcaacaagggcgtggacactgtctctgtgggtaatacgctgtactatgttaacaaacaggaggggcagtcactttacgtgaagggagagccaatcattaacttttatgatccgctggtattccccagtgacgaatttgatgctagcatctcccaagtcaatgagaaaattaaccagtctttggccttcataaggaagtcggacgaactcctgcacaatgtgaacgcgggcaagagcacaaccaatatcatgattactaccatcatcattgttataatcgtgattttactgtccctaatcgccgtcggcctcctgctttactgcaaagcacggtcaacacctgtgaccttgagtaaggatcagctgtctgggattaacaatatcgctttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6157 - RNA, 1916 nt, synthetic construct
  misc_feature 1..1916: note = mRNA product Design c-1 comprising derived and/or modified sequence from HRSV(A2)__F_DSCav1_mut6 (opt4)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6158 - RNA, 1916 nt, synthetic construct
  misc_feature 1..1916: note = mRNA product Design c-1 comprising derived and/or modified sequence from HRSV(A2)__F_DSCav1_mut6 (opt5)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagatgctgatgtgtagcacccccgccacaggatccggctctgctattgccagcggggtcgcggtgtgcaaggttctgcacctcgagggagaggtgaacaaaatcaagtccgccctgcttagcaccaataaagctgtcgtgtctctgtccaacggcgttagcgtgctcacatttaaggtcctggatcttaagaattacattgacaaacagctgctccctatcctgaacaagcaatcttgttccattccgaatcccgaaaccgtgatggagttccagcagaaaaacaatcggctgctcgaaatcacgcgcgagtttagcgtgaacgccggcgtcacaacccctgtttctacatatatgctgaccaattccgagcttctgagcctcattaacgatatgcccatcaccaacgaccagaagaaactgatgtccaataacgtgcaaatcgtgagacagcagtcttacagcattatgtgcatcattaaggaagaggtccttgcttatgtggttcagctgcctctctacggggtgatcgatacaccctgttggaaactgcatacgtcccctctgtgcaccacaaataccaaggaaggaagcaacatttgtctcacacggaccgaccgcggctggtactgcgataatgccgggtctgtctccttctttccgcaagcggagacgtgtaaggtgtgcagcaacagagttttctgcgacacaatgaactctctgacccttcccagcgaagtgaatctgtgtaatgtcgatatctttaaccctaaatatgactgcaagatcatgacctccaaaacagatgtgtctagctccgtcattaccagcctcggagccatcgtgtcttgttacggcaagacaaaatgcacggcttccaataagaacaaggggattatcaaaaccttcagcaatggatgtgactatgtttctaacaagggcgtggacacagtctccgtgggcaataccctgtactatgttaacaaacaggaggggcagagcctttacgtgaagggagagcccattatcaacttttatgatcctctggtcttcccctccgacgaatttgatgcctctatcagccaagtgaatgagaaaattaaccagtccctcgctttcatccggaagtctgacgaactgctgcacaatgtgaacgccggcaagagcacaaccaatattatgatcacgaccattatcattgttatcatcgtcattctcctgtcccttatcgccgtggggctgctcctgtactgcaaagctcgcagcacaccggtgaccctgtctaaggatcagctttccggaattaacaatatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6159 - RNA, 1916 nt, synthetic construct
  misc_feature 1..1916: note = mRNA product Design c-1 comprising derived and/or modified sequence from HRSV(A2)__F_DSCav1_mut6 (opt6)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggaactattaatcttaaaagcaaatgctataaccacaatattaacagcagtaacattctgttttgcctccggacaaaacataacagaagaattttatcaatcaacatgctctgcagtatccaaaggttacttaggcgcactacgcactggatggtatacatcagtaataacaatagaactatcaaacataaaagaaaataaatgtaacggtactgacgcaaaagtgaaactaattaaacaagaactcgacaaatacaaaaatgctgtaacagacctacaaatgctaatgtgctcaacacccgcaaccggatcaggatcagccatagcctccggagtcgcagtatgcaaagtattacatcttgaaggagaagtaaataaaataaaatcagcattactatccacaaataaagccgtagtatcactatcaaacggtgtatccgtccttacattcaaagtattagatctaaaaaactacatagataaacaactactacccatcttaaacaaacaatcatgctcaattcccaacccagaaacagtcatggaatttcaacaaaaaaacaacagactcttagaaataacacgagaattttcagtaaacgcaggagtaaccacaccagtaagtacatacatgctcaccaactcagaattattatcacttattaacgacatgccaattacaaacgaccaaaaaaaattaatgtcaaacaatgtccaaattgttagacaacaatcatactctataatgtgtataataaaagaagaagtactagcttacgtagttcaattaccactatatggcgtaatagatacaccttgctggaaactacatacatctccattatgtacaactaacacaaaagaaggatctaacatatgcctaacacgcacagatcgaggatggtactgcgataatgcaggttccgtatcattctttccacaagcagaaacatgtaaagtatgctcaaacagagtattctgtgacactatgaactccttaaccctaccctcagaagtcaatctatgcaacgttgacatatttaacccaaaatacgactgtaaaatcatgacatctaaaacagacgtatcatcatcagttattacatccctaggagcaatagtatcttgctacggaaaaacaaaatgtacagcatccaacaaaaacaaaggaataatcaaaacattctcaaacggctgcgactacgtatcaaacaaaggtgtagacacagtatcagtaggaaatactttatattacgtaaataaacaagaaggacaatctctatacgttaaaggcgaacctattataaacttctacgacccactcgtattcccttcagacgaatttgacgcatctatatcccaagttaacgaaaaaatcaaccaatcattagcctttataagaaaatccgacgaattattacataacgtcaacgctggaaaatcaacaactaacataatgataaccacaataataatagtcatcatagttatattactaagtctaatagccgtaggcctcctactttattgcaaagcaagatcaacaccagtaacattatccaaagaccaactcagcggcataaacaatatagctttttcaaactagggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6160 - RNA, 1916 nt, synthetic construct
  misc_feature 1..1916: note = mRNA product Design c-1 comprising derived and/or modified sequence from HRSV(A2)__F_DSCav1_mut6 (opt11)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggaactcctcatcctcaaagccaacgcaatcacaaccatactaactgcagttactttctgcttcgcatccggccaaaacatcaccgaagagttctaccaatcaacctgctccgcagtctccaaaggatacctcggagcccttcgcaccggctggtacacctccgtcataaccatcgaactctcaaacataaaagaaaacaaatgcaacggcacagacgcgaaagtcaaacttatcaaacaagaactcgacaaatacaaaaacgccgtcaccgacctgcagatgctcatgtgctcaacccccgccacaggaagcggctctgctatcgcttccggcgtcgccgtctgcaaagtcctccacctcgaaggcgaagtaaacaaaatcaagtcagccctcctctccaccaacaaagccgtcgtctctctctcaaacggcgtatccgtcctcacattcaaagtcctcgacctcaaaaactacatcgacaaacaacttctccccatcctaaacaaacaatcatgctccatccccaaccccgaaacagtcatggaatttcaacaaaagaacaaccgcctcttagaaatcacccgagaattttccgtcaacgcgggagtcacaacccccgtttctacgtatatgctcaccaactccgaactcctttccctcataaacgacatgccaatcaccaacgaccaaaagaaactcatgtcaaacaacgtccaaatcgtccgacaacaatcctactctattatgtgcatcatcaaagaagaagttctcgcctacgtcgtccaactacccctctacggcgtgatcgacaccccctgctggaaactacacacctcacccctctgcaccaccaacaccaaggaaggctccaacatctgcctcacccgcaccgaccgcggctggtactgcgacaacgctggctccgtctcattcttcccgcaagccgaaacttgcaaagtatgctccaacagagtattctgcgacaccatgaactcactaaccctcccttccgaagtcaacctttgcaacgttgacatattcaacccaaagtacgattgcaaaattatgacatccaaaacagatgtctcctcctccgtcatcacatccctcggtgccattgtatcatgctacggaaaaaccaaatgcaccgcatccaacaaaaacaaaggaatcatcaaaaccttctcaaacggctgcgattacgtctcaaacaaaggagtcgacacagtctccgtcggaaacaccctatactacgtcaacaaacaagaaggccaatccctgtacgtcaaaggagaacccatcatcaacttctacgaccccctcgtcttcccgagcgacgagttcgacgcctccatctcacaagtcaatgaaaagatcaaccaatcccttgccttcatccggaaatcggacgaactcctacacaacgtgaacgctggaaaatcaaccaccaacatcatgatcacaaccatcattatcgtcatcatcgtcatactcctctccctaatcgccgtcggcctcctcctgtattgcaaagctcgctccacccccgtcaccctgtccaaagaccaactctccggaatcaacaacatcgccttctcaaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6161 - RNA, 2006 nt, synthetic construct
  misc_feature 1..2006: note = mRNA product Design c-2 comprising derived and/or modified sequence from HRSV(A2)__F_DSCav1_mut6 (opt1)
  source 1..2006: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaaccccgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6162 - RNA, 2006 nt, synthetic construct
  misc_feature 1..2006: note = mRNA product Design c-2 comprising derived and/or modified sequence from HRSV(A2)__F_DSCav1_mut6 (opt1)
  source 1..2006: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctcatgtgcagcacccccgccaccgggtccggcagcgccatcgcctccggcgtggcggtgtgcaaggtcctgcacctggagggggaggtgaacaagatcaagagcgccctcctgtccaccaacaaggccgtggtcagcctgtccaacggcgtgagcgtgctcacgttcaaggtcctggacctgaagaactacatcgacaagcagctcctgccgatcctgaacaagcagtcctgcagcatccccaaccccgagaccgtgatggagttccagcagaagaacaaccggctcctggagatcacccgcgagttctccgtgaacgccggggtcaccacgcccgtgagcacctacatgctgaccaactccgagctcctgagcctgatcaacgacatgccgatcaccaacgaccagaagaagctcatgagcaacaacgtgcagatcgtccggcagcagtcctacagcatcatgtgcatcatcaaggaggaggtgctggcctacgtggtccagctgcccctctacggcgtgatcgacacgccctgctggaagctgcacaccagccccctgtgcaccaccaacacgaaggaggggagcaacatctgcctcacccgcaccgaccggggctggtactgcgacaacgcgggctccgtgagcttcttcccgcaggccgagacctgcaaggtctgctccaaccgcgtgttctgcgacacgatgaacagcctgaccctgccctccgaggtcaacctctgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaacaaggggatcatcaagaccttctccaacggctgcgactacgtgagcaacaagggcgtcgacacggtgtccgtggggaacaccctgtactacgtcaacaagcaggagggccagagcctctacgtgaagggggagcccatcatcaacttctacgacccgctggtgttccccagcgacgagttcgacgcctccatcagccaggtcaacgagaagatcaaccagtccctggcgttcatccggaagtccgacgagctcctgcacaacgtgaacgccggcaagtccaccaccaacatcatgatcaccacgatcatcatcgtgatcatcgtcatcctgctcagcctgatcgccgtggggctgctcctgtactgcaaggcccgctccacccccgtgaccctgagcaaggaccagctgtccggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6163 - RNA, 2006 nt, synthetic construct
  misc_feature 1..2006: note = mRNA product Design c-2 comprising derived and/or modified sequence from HRSV(A2)__F_DSCav1_mut6 (opt2)
  source 1..2006: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6164 - RNA, 2006 nt, synthetic construct
  misc_feature 1..2006: note = mRNA product Design c-2 comprising derived and/or modified sequence from HRSV(A2)__F_DSCav1_mut6 (opt3)
  source 1..2006: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagatgcttatgtgttccacacccgccaccgggtctggatcggctatagcatcaggcgtggccgtctgcaaggtgctgcacttggagggtgaggttaacaaaatcaagagcgctctcctgagtacgaataaagccgtggtctccctgtctaacggggtgagcgtactcacttttaaggttttagatctgaagaattacattgacaaacagcttttgcctatcctgaacaagcaatcctgttcaattccaaatccggaaaccgtgatggagttccagcagaaaaacaataggctactcgaaatcacacgggagtttagtgtcaacgcgggagtgactacccccgtgagcacatatatgctgaccaattctgagcttctgtccttgataaacgatatgcctattacgaacgaccagaagaaactcatgtcaaataacgtccaaatcgttcgccagcagagctacagtattatgtgcatcatcaaggaagaggtgctggcatatgtagtgcagttaccactgtacggcgtcattgatactccctgttggaaactccatacatctcctctttgcaccactaatacaaaggaaggctccaacatatgtctgacccgaacggaccgtgggtggtactgcgataatgccggaagcgtgtcgttctttccacaagctgagacctgtaaggtttgctctaacagagtgttctgcgacacaatgaactccttgactctaccctcagaagtcaatctgtgtaatgtggatatctttaaccctaaatatgactgcaagattatgaccagtaaaacagatgtaagctcctctgttatcactagcctcggtgccatagtgtcatgttacggcaagaccaaatgcacagcaagtaataagaacaaggggattatcaaaaccttctccaatggatgtgactatgtcagcaacaagggcgtggacactgtctctgtgggtaatacgctgtactatgttaacaaacaggaggggcagtcactttacgtgaagggagagccaatcattaacttttatgatccgctggtattccccagtgacgaatttgatgctagcatctcccaagtcaatgagaaaattaaccagtctttggccttcataaggaagtcggacgaactcctgcacaatgtgaacgcgggcaagagcacaaccaatatcatgattactaccatcatcattgttataatcgtgattttactgtccctaatcgccgtcggcctcctgctttactgcaaagcacggtcaacacctgtgaccttgagtaaggatcagctgtctgggattaacaatatcgctttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6165 - RNA, 2006 nt, synthetic construct
  misc_feature 1..2006: note = mRNA product Design c-2 comprising derived and/or modified sequence from HRSV(A2)__F_DSCav1_mut6 (opt4)
  source 1..2006: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6166 - RNA, 2006 nt, synthetic construct
  misc_feature 1..2006: note = mRNA product Design c-2 comprising derived and/or modified sequence from HRSV(A2)__F_DSCav1_mut6 (opt5)
  source 1..2006: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagatgctgatgtgtagcacccccgccacaggatccggctctgctattgccagcggggtcgcggtgtgcaaggttctgcacctcgagggagaggtgaacaaaatcaagtccgccctgcttagcaccaataaagctgtcgtgtctctgtccaacggcgttagcgtgctcacatttaaggtcctggatcttaagaattacattgacaaacagctgctccctatcctgaacaagcaatcttgttccattccgaatcccgaaaccgtgatggagttccagcagaaaaacaatcggctgctcgaaatcacgcgcgagtttagcgtgaacgccggcgtcacaacccctgtttctacatatatgctgaccaattccgagcttctgagcctcattaacgatatgcccatcaccaacgaccagaagaaactgatgtccaataacgtgcaaatcgtgagacagcagtcttacagcattatgtgcatcattaaggaagaggtccttgcttatgtggttcagctgcctctctacggggtgatcgatacaccctgttggaaactgcatacgtcccctctgtgcaccacaaataccaaggaaggaagcaacatttgtctcacacggaccgaccgcggctggtactgcgataatgccgggtctgtctccttctttccgcaagcggagacgtgtaaggtgtgcagcaacagagttttctgcgacacaatgaactctctgacccttcccagcgaagtgaatctgtgtaatgtcgatatctttaaccctaaatatgactgcaagatcatgacctccaaaacagatgtgtctagctccgtcattaccagcctcggagccatcgtgtcttgttacggcaagacaaaatgcacggcttccaataagaacaaggggattatcaaaaccttcagcaatggatgtgactatgtttctaacaagggcgtggacacagtctccgtgggcaataccctgtactatgttaacaaacaggaggggcagagcctttacgtgaagggagagcccattatcaacttttatgatcctctggtcttcccctccgacgaatttgatgcctctatcagccaagtgaatgagaaaattaaccagtccctcgctttcatccggaagtctgacgaactgctgcacaatgtgaacgccggcaagagcacaaccaatattatgatcacgaccattatcattgttatcatcgtcattctcctgtcccttatcgccgtggggctgctcctgtactgcaaagctcgcagcacaccggtgaccctgtctaaggatcagctttccggaattaacaatatcgcgttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6167 - RNA, 2006 nt, synthetic construct
  misc_feature 1..2006: note = mRNA product Design c-2 comprising derived and/or modified sequence from HRSV(A2)__F_DSCav1_mut6 (opt6)
  source 1..2006: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactattaatcttaaaagcaaatgctataaccacaatattaacagcagtaacattctgttttgcctccggacaaaacataacagaagaattttatcaatcaacatgctctgcagtatccaaaggttacttaggcgcactacgcactggatggtatacatcagtaataacaatagaactatcaaacataaaagaaaataaatgtaacggtactgacgcaaaagtgaaactaattaaacaagaactcgacaaatacaaaaatgctgtaacagacctacaaatgctaatgtgctcaacacccgcaaccggatcaggatcagccatagcctccggagtcgcagtatgcaaagtattacatcttgaaggagaagtaaataaaataaaatcagcattactatccacaaataaagccgtagtatcactatcaaacggtgtatccgtccttacattcaaagtattagatctaaaaaactacatagataaacaactactacccatcttaaacaaacaatcatgctcaattcccaacccagaaacagtcatggaatttcaacaaaaaaacaacagactcttagaaataacacgagaattttcagtaaacgcaggagtaaccacaccagtaagtacatacatgctcaccaactcagaattattatcacttattaacgacatgccaattacaaacgaccaaaaaaaattaatgtcaaacaatgtccaaattgttagacaacaatcatactctataatgtgtataataaaagaagaagtactagcttacgtagttcaattaccactatatggcgtaatagatacaccttgctggaaactacatacatctccattatgtacaactaacacaaaagaaggatctaacatatgcctaacacgcacagatcgaggatggtactgcgataatgcaggttccgtatcattctttccacaagcagaaacatgtaaagtatgctcaaacagagtattctgtgacactatgaactccttaaccctaccctcagaagtcaatctatgcaacgttgacatatttaacccaaaatacgactgtaaaatcatgacatctaaaacagacgtatcatcatcagttattacatccctaggagcaatagtatcttgctacggaaaaacaaaatgtacagcatccaacaaaaacaaaggaataatcaaaacattctcaaacggctgcgactacgtatcaaacaaaggtgtagacacagtatcagtaggaaatactttatattacgtaaataaacaagaaggacaatctctatacgttaaaggcgaacctattataaacttctacgacccactcgtattcccttcagacgaatttgacgcatctatatcccaagttaacgaaaaaatcaaccaatcattagcctttataagaaaatccgacgaattattacataacgtcaacgctggaaaatcaacaactaacataatgataaccacaataataatagtcatcatagttatattactaagtctaatagccgtaggcctcctactttattgcaaagcaagatcaacaccagtaacattatccaaagaccaactcagcggcataaacaatatagctttttcaaactagggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6168 - RNA, 2006 nt, synthetic construct
  misc_feature 1..2006: note = mRNA product Design c-2 comprising derived and/or modified sequence from HRSV(A2)__F_DSCav1_mut6 (opt11)
  source 1..2006: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactcctcatcctcaaagccaacgcaatcacaaccatactaactgcagttactttctgcttcgcatccggccaaaacatcaccgaagagttctaccaatcaacctgctccgcagtctccaaaggatacctcggagcccttcgcaccggctggtacacctccgtcataaccatcgaactctcaaacataaaagaaaacaaatgcaacggcacagacgcgaaagtcaaacttatcaaacaagaactcgacaaatacaaaaacgccgtcaccgacctgcagatgctcatgtgctcaacccccgccacaggaagcggctctgctatcgcttccggcgtcgccgtctgcaaagtcctccacctcgaaggcgaagtaaacaaaatcaagtcagccctcctctccaccaacaaagccgtcgtctctctctcaaacggcgtatccgtcctcacattcaaagtcctcgacctcaaaaactacatcgacaaacaacttctccccatcctaaacaaacaatcatgctccatccccaaccccgaaacagtcatggaatttcaacaaaagaacaaccgcctcttagaaatcacccgagaattttccgtcaacgcgggagtcacaacccccgtttctacgtatatgctcaccaactccgaactcctttccctcataaacgacatgccaatcaccaacgaccaaaagaaactcatgtcaaacaacgtccaaatcgtccgacaacaatcctactctattatgtgcatcatcaaagaagaagttctcgcctacgtcgtccaactacccctctacggcgtgatcgacaccccctgctggaaactacacacctcacccctctgcaccaccaacaccaaggaaggctccaacatctgcctcacccgcaccgaccgcggctggtactgcgacaacgctggctccgtctcattcttcccgcaagccgaaacttgcaaagtatgctccaacagagtattctgcgacaccatgaactcactaaccctcccttccgaagtcaacctttgcaacgttgacatattcaacccaaagtacgattgcaaaattatgacatccaaaacagatgtctcctcctccgtcatcacatccctcggtgccattgtatcatgctacggaaaaaccaaatgcaccgcatccaacaaaaacaaaggaatcatcaaaaccttctcaaacggctgcgattacgtctcaaacaaaggagtcgacacagtctccgtcggaaacaccctatactacgtcaacaaacaagaaggccaatccctgtacgtcaaaggagaacccatcatcaacttctacgaccccctcgtcttcccgagcgacgagttcgacgcctccatctcacaagtcaatgaaaagatcaaccaatcccttgccttcatccggaaatcggacgaactcctacacaacgtgaacgctggaaaatcaaccaccaacatcatgatcacaaccatcattatcgtcatcatcgtcatactcctctccctaatcgccgtcggcctcctcctgtattgcaaagctcgctccacccccgtcaccctgtccaaagaccaactctccggaatcaacaacatcgccttctcaaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6169 - RNA, 1983 nt, synthetic construct
  misc_feature 1..1983: note = mRNA product Design c-3 comprising derived and/or modified sequence from HRSV(A2)__F_DSCav1_mut6 (opt1)
  source 1..1983: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaaccccgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6170 - RNA, 1983 nt, synthetic construct
  misc_feature 1..1983: note = mRNA product Design c-3 comprising derived and/or modified sequence from HRSV(A2)__F_DSCav1_mut6 (opt1)
  source 1..1983: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctcatgtgcagcacccccgccaccgggtccggcagcgccatcgcctccggcgtggcggtgtgcaaggtcctgcacctggagggggaggtgaacaagatcaagagcgccctcctgtccaccaacaaggccgtggtcagcctgtccaacggcgtgagcgtgctcacgttcaaggtcctggacctgaagaactacatcgacaagcagctcctgccgatcctgaacaagcagtcctgcagcatccccaaccccgagaccgtgatggagttccagcagaagaacaaccggctcctggagatcacccgcgagttctccgtgaacgccggggtcaccacgcccgtgagcacctacatgctgaccaactccgagctcctgagcctgatcaacgacatgccgatcaccaacgaccagaagaagctcatgagcaacaacgtgcagatcgtccggcagcagtcctacagcatcatgtgcatcatcaaggaggaggtgctggcctacgtggtccagctgcccctctacggcgtgatcgacacgccctgctggaagctgcacaccagccccctgtgcaccaccaacacgaaggaggggagcaacatctgcctcacccgcaccgaccggggctggtactgcgacaacgcgggctccgtgagcttcttcccgcaggccgagacctgcaaggtctgctccaaccgcgtgttctgcgacacgatgaacagcctgaccctgccctccgaggtcaacctctgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaacaaggggatcatcaagaccttctccaacggctgcgactacgtgagcaacaagggcgtcgacacggtgtccgtggggaacaccctgtactacgtcaacaagcaggagggccagagcctctacgtgaagggggagcccatcatcaacttctacgacccgctggtgttccccagcgacgagttcgacgcctccatcagccaggtcaacgagaagatcaaccagtccctggcgttcatccggaagtccgacgagctcctgcacaacgtgaacgccggcaagtccaccaccaacatcatgatcaccacgatcatcatcgtgatcatcgtcatcctgctcagcctgatcgccgtggggctgctcctgtactgcaaggcccgctccacccccgtgaccctgagcaaggaccagctgtccggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6171 - RNA, 1983 nt, synthetic construct
  misc_feature 1..1983: note = mRNA product Design c-3 comprising derived and/or modified sequence from HRSV(A2)__F_DSCav1_mut6 (opt2)
  source 1..1983: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6172 - RNA, 1983 nt, synthetic construct
  misc_feature 1..1983: note = mRNA product Design c-3 comprising derived and/or modified sequence from HRSV(A2)__F_DSCav1_mut6 (opt3)
  source 1..1983: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagatgcttatgtgttccacacccgccaccgggtctggatcggctatagcatcaggcgtggccgtctgcaaggtgctgcacttggagggtgaggttaacaaaatcaagagcgctctcctgagtacgaataaagccgtggtctccctgtctaacggggtgagcgtactcacttttaaggttttagatctgaagaattacattgacaaacagcttttgcctatcctgaacaagcaatcctgttcaattccaaatccggaaaccgtgatggagttccagcagaaaaacaataggctactcgaaatcacacgggagtttagtgtcaacgcgggagtgactacccccgtgagcacatatatgctgaccaattctgagcttctgtccttgataaacgatatgcctattacgaacgaccagaagaaactcatgtcaaataacgtccaaatcgttcgccagcagagctacagtattatgtgcatcatcaaggaagaggtgctggcatatgtagtgcagttaccactgtacggcgtcattgatactccctgttggaaactccatacatctcctctttgcaccactaatacaaaggaaggctccaacatatgtctgacccgaacggaccgtgggtggtactgcgataatgccggaagcgtgtcgttctttccacaagctgagacctgtaaggtttgctctaacagagtgttctgcgacacaatgaactccttgactctaccctcagaagtcaatctgtgtaatgtggatatctttaaccctaaatatgactgcaagattatgaccagtaaaacagatgtaagctcctctgttatcactagcctcggtgccatagtgtcatgttacggcaagaccaaatgcacagcaagtaataagaacaaggggattatcaaaaccttctccaatggatgtgactatgtcagcaacaagggcgtggacactgtctctgtgggtaatacgctgtactatgttaacaaacaggaggggcagtcactttacgtgaagggagagccaatcattaacttttatgatccgctggtattccccagtgacgaatttgatgctagcatctcccaagtcaatgagaaaattaaccagtctttggccttcataaggaagtcggacgaactcctgcacaatgtgaacgcgggcaagagcacaaccaatatcatgattactaccatcatcattgttataatcgtgattttactgtccctaatcgccgtcggcctcctgctttactgcaaagcacggtcaacacctgtgaccttgagtaaggatcagctgtctgggattaacaatatcgctttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6173 - RNA, 1983 nt, synthetic construct
  misc_feature 1..1983: note = mRNA product Design c-3 comprising derived and/or modified sequence from HRSV(A2)__F_DSCav1_mut6 (opt4)
  source 1..1983: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6174 - RNA, 1983 nt, synthetic construct
  misc_feature 1..1983: note = mRNA product Design c-3 comprising derived and/or modified sequence from HRSV(A2)__F_DSCav1_mut6 (opt5)
  source 1..1983: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagatgctgatgtgtagcacccccgccacaggatccggctctgctattgccagcggggtcgcggtgtgcaaggttctgcacctcgagggagaggtgaacaaaatcaagtccgccctgcttagcaccaataaagctgtcgtgtctctgtccaacggcgttagcgtgctcacatttaaggtcctggatcttaagaattacattgacaaacagctgctccctatcctgaacaagcaatcttgttccattccgaatcccgaaaccgtgatggagttccagcagaaaaacaatcggctgctcgaaatcacgcgcgagtttagcgtgaacgccggcgtcacaacccctgtttctacatatatgctgaccaattccgagcttctgagcctcattaacgatatgcccatcaccaacgaccagaagaaactgatgtccaataacgtgcaaatcgtgagacagcagtcttacagcattatgtgcatcattaaggaagaggtccttgcttatgtggttcagctgcctctctacggggtgatcgatacaccctgttggaaactgcatacgtcccctctgtgcaccacaaataccaaggaaggaagcaacatttgtctcacacggaccgaccgcggctggtactgcgataatgccgggtctgtctccttctttccgcaagcggagacgtgtaaggtgtgcagcaacagagttttctgcgacacaatgaactctctgacccttcccagcgaagtgaatctgtgtaatgtcgatatctttaaccctaaatatgactgcaagatcatgacctccaaaacagatgtgtctagctccgtcattaccagcctcggagccatcgtgtcttgttacggcaagacaaaatgcacggcttccaataagaacaaggggattatcaaaaccttcagcaatggatgtgactatgtttctaacaagggcgtggacacagtctccgtgggcaataccctgtactatgttaacaaacaggaggggcagagcctttacgtgaagggagagcccattatcaacttttatgatcctctggtcttcccctccgacgaatttgatgcctctatcagccaagtgaatgagaaaattaaccagtccctcgctttcatccggaagtctgacgaactgctgcacaatgtgaacgccggcaagagcacaaccaatattatgatcacgaccattatcattgttatcatcgtcattctcctgtcccttatcgccgtggggctgctcctgtactgcaaagctcgcagcacaccggtgaccctgtctaaggatcagctttccggaattaacaatatcgcgttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6175 - RNA, 1983 nt, synthetic construct
  misc_feature 1..1983: note = mRNA product Design c-3 comprising derived and/or modified sequence from HRSV(A2)__F_DSCav1_mut6 (opt6)
  source 1..1983: mol_type = other RNA
gggagagtccgctcagccaggttgcagaagcggcttagcgtgtgtcctaatcttctctctgcgtgtaggtaggcctgtgccgcaaacaagcttaccatggaactattaatcttaaaagcaaatgctataaccacaatattaacagcagtaacattctgttttgcctccggacaaaacataacagaagaattttatcaatcaacatgctctgcagtatccaaaggttacttaggcgcactacgcactggatggtatacatcagtaataacaatagaactatcaaacataaaagaaaataaatgtaacggtactgacgcaaaagtgaaactaattaaacaagaactcgacaaatacaaaaatgctgtaacagacctacaaatgctaatgtgctcaacacccgcaaccggatcaggatcagccatagcctccggagtcgcagtatgcaaagtattacatcttgaaggagaagtaaataaaataaaatcagcattactatccacaaataaagccgtagtatcactatcaaacggtgtatccgtccttacattcaaagtattagatctaaaaaactacatagataaacaactactacccatcttaaacaaacaatcatgctcaattcccaacccagaaacagtcatggaatttcaacaaaaaaacaacagactcttagaaataacacgagaattttcagtaaacgcaggagtaaccacaccagtaagtacatacatgctcaccaactcagaattattatcacttattaacgacatgccaattacaaacgaccaaaaaaaattaatgtcaaacaatgtccaaattgttagacaacaatcatactctataatgtgtataataaaagaagaagtactagcttacgtagttcaattaccactatatggcgtaatagatacaccttgctggaaactacatacatctccattatgtacaactaacacaaaagaaggatctaacatatgcctaacacgcacagatcgaggatggtactgcgataatgcaggttccgtatcattctttccacaagcagaaacatgtaaagtatgctcaaacagagtattctgtgacactatgaactccttaaccctaccctcagaagtcaatctatgcaacgttgacatatttaacccaaaatacgactgtaaaatcatgacatctaaaacagacgtatcatcatcagttattacatccctaggagcaatagtatcttgctacggaaaaacaaaatgtacagcatccaacaaaaacaaaggaataatcaaaacattctcaaacggctgcgactacgtatcaaacaaaggtgtagacacagtatcagtaggaaatactttatattacgtaaataaacaagaaggacaatctctatacgttaaaggcgaacctattataaacttctacgacccactcgtattcccttcagacgaatttgacgcatctatatcccaagttaacgaaaaaatcaaccaatcattagcctttataagaaaatccgacgaattattacataacgtcaacgctggaaaatcaacaactaacataatgataaccacaataataatagtcatcatagttatattactaagtctaatagccgtaggcctcctactttattgcaaagcaagatcaacaccagtaacattatccaaagaccaactcagcggcataaacaatatagctttttcaaactagggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6176 - RNA, 1983 nt, synthetic construct
  misc_feature 1..1983: note = mRNA product Design c-3 comprising derived and/or modified sequence from HRSV(A2)__F_DSCav1_mut6 (opt11)
  source 1..1983: mol_type = other RNA
gggagagtccgctcagccaggttgcagaagcggcttagcgtgtgtcctaatcttctctctgcgtgtaggtaggcctgtgccgcaaacaagcttaccatggaactcctcatcctcaaagccaacgcaatcacaaccatactaactgcagttactttctgcttcgcatccggccaaaacatcaccgaagagttctaccaatcaacctgctccgcagtctccaaaggatacctcggagcccttcgcaccggctggtacacctccgtcataaccatcgaactctcaaacataaaagaaaacaaatgcaacggcacagacgcgaaagtcaaacttatcaaacaagaactcgacaaatacaaaaacgccgtcaccgacctgcagatgctcatgtgctcaacccccgccacaggaagcggctctgctatcgcttccggcgtcgccgtctgcaaagtcctccacctcgaaggcgaagtaaacaaaatcaagtcagccctcctctccaccaacaaagccgtcgtctctctctcaaacggcgtatccgtcctcacattcaaagtcctcgacctcaaaaactacatcgacaaacaacttctccccatcctaaacaaacaatcatgctccatccccaaccccgaaacagtcatggaatttcaacaaaagaacaaccgcctcttagaaatcacccgagaattttccgtcaacgcgggagtcacaacccccgtttctacgtatatgctcaccaactccgaactcctttccctcataaacgacatgccaatcaccaacgaccaaaagaaactcatgtcaaacaacgtccaaatcgtccgacaacaatcctactctattatgtgcatcatcaaagaagaagttctcgcctacgtcgtccaactacccctctacggcgtgatcgacaccccctgctggaaactacacacctcacccctctgcaccaccaacaccaaggaaggctccaacatctgcctcacccgcaccgaccgcggctggtactgcgacaacgctggctccgtctcattcttcccgcaagccgaaacttgcaaagtatgctccaacagagtattctgcgacaccatgaactcactaaccctcccttccgaagtcaacctttgcaacgttgacatattcaacccaaagtacgattgcaaaattatgacatccaaaacagatgtctcctcctccgtcatcacatccctcggtgccattgtatcatgctacggaaaaaccaaatgcaccgcatccaacaaaaacaaaggaatcatcaaaaccttctcaaacggctgcgattacgtctcaaacaaaggagtcgacacagtctccgtcggaaacaccctatactacgtcaacaaacaagaaggccaatccctgtacgtcaaaggagaacccatcatcaacttctacgaccccctcgtcttcccgagcgacgagttcgacgcctccatctcacaagtcaatgaaaagatcaaccaatcccttgccttcatccggaaatcggacgaactcctacacaacgtgaacgctggaaaatcaaccaccaacatcatgatcacaaccatcattatcgtcatcatcgtcatactcctctccctaatcgccgtcggcctcctcctgtattgcaaagctcgctccacccccgtcaccctgtccaaagaccaactctccggaatcaacaacatcgccttctcaaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6177 - RNA, 1979 nt, synthetic construct
  misc_feature 1..1979: note = mRNA product Design c-4 comprising derived and/or modified sequence from HRSV(A2)__F_DSCav1_mut6 (opt1)
  source 1..1979: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaaccccgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6178 - RNA, 1979 nt, synthetic construct
  misc_feature 1..1979: note = mRNA product Design c-4 comprising derived and/or modified sequence from HRSV(A2)__F_DSCav1_mut6 (opt1)
  source 1..1979: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctcatgtgcagcacccccgccaccgggtccggcagcgccatcgcctccggcgtggcggtgtgcaaggtcctgcacctggagggggaggtgaacaagatcaagagcgccctcctgtccaccaacaaggccgtggtcagcctgtccaacggcgtgagcgtgctcacgttcaaggtcctggacctgaagaactacatcgacaagcagctcctgccgatcctgaacaagcagtcctgcagcatccccaaccccgagaccgtgatggagttccagcagaagaacaaccggctcctggagatcacccgcgagttctccgtgaacgccggggtcaccacgcccgtgagcacctacatgctgaccaactccgagctcctgagcctgatcaacgacatgccgatcaccaacgaccagaagaagctcatgagcaacaacgtgcagatcgtccggcagcagtcctacagcatcatgtgcatcatcaaggaggaggtgctggcctacgtggtccagctgcccctctacggcgtgatcgacacgccctgctggaagctgcacaccagccccctgtgcaccaccaacacgaaggaggggagcaacatctgcctcacccgcaccgaccggggctggtactgcgacaacgcgggctccgtgagcttcttcccgcaggccgagacctgcaaggtctgctccaaccgcgtgttctgcgacacgatgaacagcctgaccctgccctccgaggtcaacctctgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaacaaggggatcatcaagaccttctccaacggctgcgactacgtgagcaacaagggcgtcgacacggtgtccgtggggaacaccctgtactacgtcaacaagcaggagggccagagcctctacgtgaagggggagcccatcatcaacttctacgacccgctggtgttccccagcgacgagttcgacgcctccatcagccaggtcaacgagaagatcaaccagtccctggcgttcatccggaagtccgacgagctcctgcacaacgtgaacgccggcaagtccaccaccaacatcatgatcaccacgatcatcatcgtgatcatcgtcatcctgctcagcctgatcgccgtggggctgctcctgtactgcaaggcccgctccacccccgtgaccctgagcaaggaccagctgtccggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6179 - RNA, 1979 nt, synthetic construct
  misc_feature 1..1979: note = mRNA product Design c-4 comprising derived and/or modified sequence from HRSV(A2)__F_DSCav1_mut6 (opt2)
  source 1..1979: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6180 - RNA, 1979 nt, synthetic construct
  misc_feature 1..1979: note = mRNA product Design c-4 comprising derived and/or modified sequence from HRSV(A2)__F_DSCav1_mut6 (opt3)
  source 1..1979: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagatgcttatgtgttccacacccgccaccgggtctggatcggctatagcatcaggcgtggccgtctgcaaggtgctgcacttggagggtgaggttaacaaaatcaagagcgctctcctgagtacgaataaagccgtggtctccctgtctaacggggtgagcgtactcacttttaaggttttagatctgaagaattacattgacaaacagcttttgcctatcctgaacaagcaatcctgttcaattccaaatccggaaaccgtgatggagttccagcagaaaaacaataggctactcgaaatcacacgggagtttagtgtcaacgcgggagtgactacccccgtgagcacatatatgctgaccaattctgagcttctgtccttgataaacgatatgcctattacgaacgaccagaagaaactcatgtcaaataacgtccaaatcgttcgccagcagagctacagtattatgtgcatcatcaaggaagaggtgctggcatatgtagtgcagttaccactgtacggcgtcattgatactccctgttggaaactccatacatctcctctttgcaccactaatacaaaggaaggctccaacatatgtctgacccgaacggaccgtgggtggtactgcgataatgccggaagcgtgtcgttctttccacaagctgagacctgtaaggtttgctctaacagagtgttctgcgacacaatgaactccttgactctaccctcagaagtcaatctgtgtaatgtggatatctttaaccctaaatatgactgcaagattatgaccagtaaaacagatgtaagctcctctgttatcactagcctcggtgccatagtgtcatgttacggcaagaccaaatgcacagcaagtaataagaacaaggggattatcaaaaccttctccaatggatgtgactatgtcagcaacaagggcgtggacactgtctctgtgggtaatacgctgtactatgttaacaaacaggaggggcagtcactttacgtgaagggagagccaatcattaacttttatgatccgctggtattccccagtgacgaatttgatgctagcatctcccaagtcaatgagaaaattaaccagtctttggccttcataaggaagtcggacgaactcctgcacaatgtgaacgcgggcaagagcacaaccaatatcatgattactaccatcatcattgttataatcgtgattttactgtccctaatcgccgtcggcctcctgctttactgcaaagcacggtcaacacctgtgaccttgagtaaggatcagctgtctgggattaacaatatcgctttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6181 - RNA, 1979 nt, synthetic construct
  misc_feature 1..1979: note = mRNA product Design c-4 comprising derived and/or modified sequence from HRSV(A2)__F_DSCav1_mut6 (opt4)
  source 1..1979: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6182 - RNA, 1979 nt, synthetic construct
  misc_feature 1..1979: note = mRNA product Design c-4 comprising derived and/or modified sequence from HRSV(A2)__F_DSCav1_mut6 (opt5)
  source 1..1979: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagatgctgatgtgtagcacccccgccacaggatccggctctgctattgccagcggggtcgcggtgtgcaaggttctgcacctcgagggagaggtgaacaaaatcaagtccgccctgcttagcaccaataaagctgtcgtgtctctgtccaacggcgttagcgtgctcacatttaaggtcctggatcttaagaattacattgacaaacagctgctccctatcctgaacaagcaatcttgttccattccgaatcccgaaaccgtgatggagttccagcagaaaaacaatcggctgctcgaaatcacgcgcgagtttagcgtgaacgccggcgtcacaacccctgtttctacatatatgctgaccaattccgagcttctgagcctcattaacgatatgcccatcaccaacgaccagaagaaactgatgtccaataacgtgcaaatcgtgagacagcagtcttacagcattatgtgcatcattaaggaagaggtccttgcttatgtggttcagctgcctctctacggggtgatcgatacaccctgttggaaactgcatacgtcccctctgtgcaccacaaataccaaggaaggaagcaacatttgtctcacacggaccgaccgcggctggtactgcgataatgccgggtctgtctccttctttccgcaagcggagacgtgtaaggtgtgcagcaacagagttttctgcgacacaatgaactctctgacccttcccagcgaagtgaatctgtgtaatgtcgatatctttaaccctaaatatgactgcaagatcatgacctccaaaacagatgtgtctagctccgtcattaccagcctcggagccatcgtgtcttgttacggcaagacaaaatgcacggcttccaataagaacaaggggattatcaaaaccttcagcaatggatgtgactatgtttctaacaagggcgtggacacagtctccgtgggcaataccctgtactatgttaacaaacaggaggggcagagcctttacgtgaagggagagcccattatcaacttttatgatcctctggtcttcccctccgacgaatttgatgcctctatcagccaagtgaatgagaaaattaaccagtccctcgctttcatccggaagtctgacgaactgctgcacaatgtgaacgccggcaagagcacaaccaatattatgatcacgaccattatcattgttatcatcgtcattctcctgtcccttatcgccgtggggctgctcctgtactgcaaagctcgcagcacaccggtgaccctgtctaaggatcagctttccggaattaacaatatcgcgttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6183 - RNA, 1979 nt, synthetic construct
  misc_feature 1..1979: note = mRNA product Design c-4 comprising derived and/or modified sequence from HRSV(A2)__F_DSCav1_mut6 (opt6)
  source 1..1979: mol_type = other RNA
gggagagtccgctcagccaggttgcagaagcggcttagcgtgtgtcctaatcttctctctgcgtgtaggtaggcctgtgccgcaaacaagcttaccatggaactattaatcttaaaagcaaatgctataaccacaatattaacagcagtaacattctgttttgcctccggacaaaacataacagaagaattttatcaatcaacatgctctgcagtatccaaaggttacttaggcgcactacgcactggatggtatacatcagtaataacaatagaactatcaaacataaaagaaaataaatgtaacggtactgacgcaaaagtgaaactaattaaacaagaactcgacaaatacaaaaatgctgtaacagacctacaaatgctaatgtgctcaacacccgcaaccggatcaggatcagccatagcctccggagtcgcagtatgcaaagtattacatcttgaaggagaagtaaataaaataaaatcagcattactatccacaaataaagccgtagtatcactatcaaacggtgtatccgtccttacattcaaagtattagatctaaaaaactacatagataaacaactactacccatcttaaacaaacaatcatgctcaattcccaacccagaaacagtcatggaatttcaacaaaaaaacaacagactcttagaaataacacgagaattttcagtaaacgcaggagtaaccacaccagtaagtacatacatgctcaccaactcagaattattatcacttattaacgacatgccaattacaaacgaccaaaaaaaattaatgtcaaacaatgtccaaattgttagacaacaatcatactctataatgtgtataataaaagaagaagtactagcttacgtagttcaattaccactatatggcgtaatagatacaccttgctggaaactacatacatctccattatgtacaactaacacaaaagaaggatctaacatatgcctaacacgcacagatcgaggatggtactgcgataatgcaggttccgtatcattctttccacaagcagaaacatgtaaagtatgctcaaacagagtattctgtgacactatgaactccttaaccctaccctcagaagtcaatctatgcaacgttgacatatttaacccaaaatacgactgtaaaatcatgacatctaaaacagacgtatcatcatcagttattacatccctaggagcaatagtatcttgctacggaaaaacaaaatgtacagcatccaacaaaaacaaaggaataatcaaaacattctcaaacggctgcgactacgtatcaaacaaaggtgtagacacagtatcagtaggaaatactttatattacgtaaataaacaagaaggacaatctctatacgttaaaggcgaacctattataaacttctacgacccactcgtattcccttcagacgaatttgacgcatctatatcccaagttaacgaaaaaatcaaccaatcattagcctttataagaaaatccgacgaattattacataacgtcaacgctggaaaatcaacaactaacataatgataaccacaataataatagtcatcatagttatattactaagtctaatagccgtaggcctcctactttattgcaaagcaagatcaacaccagtaacattatccaaagaccaactcagcggcataaacaatatagctttttcaaactagggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6184 - RNA, 1979 nt, synthetic construct
  misc_feature 1..1979: note = mRNA product Design c-4 comprising derived and/or modified sequence from HRSV(A2)__F_DSCav1_mut6 (opt11)
  source 1..1979: mol_type = other RNA
gggagagtccgctcagccaggttgcagaagcggcttagcgtgtgtcctaatcttctctctgcgtgtaggtaggcctgtgccgcaaacaagcttaccatggaactcctcatcctcaaagccaacgcaatcacaaccatactaactgcagttactttctgcttcgcatccggccaaaacatcaccgaagagttctaccaatcaacctgctccgcagtctccaaaggatacctcggagcccttcgcaccggctggtacacctccgtcataaccatcgaactctcaaacataaaagaaaacaaatgcaacggcacagacgcgaaagtcaaacttatcaaacaagaactcgacaaatacaaaaacgccgtcaccgacctgcagatgctcatgtgctcaacccccgccacaggaagcggctctgctatcgcttccggcgtcgccgtctgcaaagtcctccacctcgaaggcgaagtaaacaaaatcaagtcagccctcctctccaccaacaaagccgtcgtctctctctcaaacggcgtatccgtcctcacattcaaagtcctcgacctcaaaaactacatcgacaaacaacttctccccatcctaaacaaacaatcatgctccatccccaaccccgaaacagtcatggaatttcaacaaaagaacaaccgcctcttagaaatcacccgagaattttccgtcaacgcgggagtcacaacccccgtttctacgtatatgctcaccaactccgaactcctttccctcataaacgacatgccaatcaccaacgaccaaaagaaactcatgtcaaacaacgtccaaatcgtccgacaacaatcctactctattatgtgcatcatcaaagaagaagttctcgcctacgtcgtccaactacccctctacggcgtgatcgacaccccctgctggaaactacacacctcacccctctgcaccaccaacaccaaggaaggctccaacatctgcctcacccgcaccgaccgcggctggtactgcgacaacgctggctccgtctcattcttcccgcaagccgaaacttgcaaagtatgctccaacagagtattctgcgacaccatgaactcactaaccctcccttccgaagtcaacctttgcaacgttgacatattcaacccaaagtacgattgcaaaattatgacatccaaaacagatgtctcctcctccgtcatcacatccctcggtgccattgtatcatgctacggaaaaaccaaatgcaccgcatccaacaaaaacaaaggaatcatcaaaaccttctcaaacggctgcgattacgtctcaaacaaaggagtcgacacagtctccgtcggaaacaccctatactacgtcaacaaacaagaaggccaatccctgtacgtcaaaggagaacccatcatcaacttctacgaccccctcgtcttcccgagcgacgagttcgacgcctccatctcacaagtcaatgaaaagatcaaccaatcccttgccttcatccggaaatcggacgaactcctacacaacgtgaacgctggaaaatcaaccaccaacatcatgatcacaaccatcattatcgtcatcatcgtcatactcctctccctaatcgccgtcggcctcctcctgtattgcaaagctcgctccacccccgtcaccctgtccaaagaccaactctccggaatcaacaacatcgccttctcaaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6185 - RNA, 1897 nt, synthetic construct
  misc_feature 1..1897: note = mRNA product Design c-5 comprising derived and/or modified sequence from HRSV(A2)__F_DSCav1_mut6 (opt1)
  source 1..1897: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaaccccgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6186 - RNA, 1897 nt, synthetic construct
  misc_feature 1..1897: note = mRNA product Design c-5 comprising derived and/or modified sequence from HRSV(A2)__F_DSCav1_mut6 (opt1)
  source 1..1897: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctcatgtgcagcacccccgccaccgggtccggcagcgccatcgcctccggcgtggcggtgtgcaaggtcctgcacctggagggggaggtgaacaagatcaagagcgccctcctgtccaccaacaaggccgtggtcagcctgtccaacggcgtgagcgtgctcacgttcaaggtcctggacctgaagaactacatcgacaagcagctcctgccgatcctgaacaagcagtcctgcagcatccccaaccccgagaccgtgatggagttccagcagaagaacaaccggctcctggagatcacccgcgagttctccgtgaacgccggggtcaccacgcccgtgagcacctacatgctgaccaactccgagctcctgagcctgatcaacgacatgccgatcaccaacgaccagaagaagctcatgagcaacaacgtgcagatcgtccggcagcagtcctacagcatcatgtgcatcatcaaggaggaggtgctggcctacgtggtccagctgcccctctacggcgtgatcgacacgccctgctggaagctgcacaccagccccctgtgcaccaccaacacgaaggaggggagcaacatctgcctcacccgcaccgaccggggctggtactgcgacaacgcgggctccgtgagcttcttcccgcaggccgagacctgcaaggtctgctccaaccgcgtgttctgcgacacgatgaacagcctgaccctgccctccgaggtcaacctctgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaacaaggggatcatcaagaccttctccaacggctgcgactacgtgagcaacaagggcgtcgacacggtgtccgtggggaacaccctgtactacgtcaacaagcaggagggccagagcctctacgtgaagggggagcccatcatcaacttctacgacccgctggtgttccccagcgacgagttcgacgcctccatcagccaggtcaacgagaagatcaaccagtccctggcgttcatccggaagtccgacgagctcctgcacaacgtgaacgccggcaagtccaccaccaacatcatgatcaccacgatcatcatcgtgatcatcgtcatcctgctcagcctgatcgccgtggggctgctcctgtactgcaaggcccgctccacccccgtgaccctgagcaaggaccagctgtccggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6187 - RNA, 1897 nt, synthetic construct
  misc_feature 1..1897: note = mRNA product Design c-5 comprising derived and/or modified sequence from HRSV(A2)__F_DSCav1_mut6 (opt2)
  source 1..1897: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6188 - RNA, 1897 nt, synthetic construct
  misc_feature 1..1897: note = mRNA product Design c-5 comprising derived and/or modified sequence from HRSV(A2)__F_DSCav1_mut6 (opt3)
  source 1..1897: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagatgcttatgtgttccacacccgccaccgggtctggatcggctatagcatcaggcgtggccgtctgcaaggtgctgcacttggagggtgaggttaacaaaatcaagagcgctctcctgagtacgaataaagccgtggtctccctgtctaacggggtgagcgtactcacttttaaggttttagatctgaagaattacattgacaaacagcttttgcctatcctgaacaagcaatcctgttcaattccaaatccggaaaccgtgatggagttccagcagaaaaacaataggctactcgaaatcacacgggagtttagtgtcaacgcgggagtgactacccccgtgagcacatatatgctgaccaattctgagcttctgtccttgataaacgatatgcctattacgaacgaccagaagaaactcatgtcaaataacgtccaaatcgttcgccagcagagctacagtattatgtgcatcatcaaggaagaggtgctggcatatgtagtgcagttaccactgtacggcgtcattgatactccctgttggaaactccatacatctcctctttgcaccactaatacaaaggaaggctccaacatatgtctgacccgaacggaccgtgggtggtactgcgataatgccggaagcgtgtcgttctttccacaagctgagacctgtaaggtttgctctaacagagtgttctgcgacacaatgaactccttgactctaccctcagaagtcaatctgtgtaatgtggatatctttaaccctaaatatgactgcaagattatgaccagtaaaacagatgtaagctcctctgttatcactagcctcggtgccatagtgtcatgttacggcaagaccaaatgcacagcaagtaataagaacaaggggattatcaaaaccttctccaatggatgtgactatgtcagcaacaagggcgtggacactgtctctgtgggtaatacgctgtactatgttaacaaacaggaggggcagtcactttacgtgaagggagagccaatcattaacttttatgatccgctggtattccccagtgacgaatttgatgctagcatctcccaagtcaatgagaaaattaaccagtctttggccttcataaggaagtcggacgaactcctgcacaatgtgaacgcgggcaagagcacaaccaatatcatgattactaccatcatcattgttataatcgtgattttactgtccctaatcgccgtcggcctcctgctttactgcaaagcacggtcaacacctgtgaccttgagtaaggatcagctgtctgggattaacaatatcgctttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6189 - RNA, 1897 nt, synthetic construct
  misc_feature 1..1897: note = mRNA product Design c-5 comprising derived and/or modified sequence from HRSV(A2)__F_DSCav1_mut6 (opt4)
  source 1..1897: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6190 - RNA, 1897 nt, synthetic construct
  misc_feature 1..1897: note = mRNA product Design c-5 comprising derived and/or modified sequence from HRSV(A2)__F_DSCav1_mut6 (opt5)
  source 1..1897: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagatgctgatgtgtagcacccccgccacaggatccggctctgctattgccagcggggtcgcggtgtgcaaggttctgcacctcgagggagaggtgaacaaaatcaagtccgccctgcttagcaccaataaagctgtcgtgtctctgtccaacggcgttagcgtgctcacatttaaggtcctggatcttaagaattacattgacaaacagctgctccctatcctgaacaagcaatcttgttccattccgaatcccgaaaccgtgatggagttccagcagaaaaacaatcggctgctcgaaatcacgcgcgagtttagcgtgaacgccggcgtcacaacccctgtttctacatatatgctgaccaattccgagcttctgagcctcattaacgatatgcccatcaccaacgaccagaagaaactgatgtccaataacgtgcaaatcgtgagacagcagtcttacagcattatgtgcatcattaaggaagaggtccttgcttatgtggttcagctgcctctctacggggtgatcgatacaccctgttggaaactgcatacgtcccctctgtgcaccacaaataccaaggaaggaagcaacatttgtctcacacggaccgaccgcggctggtactgcgataatgccgggtctgtctccttctttccgcaagcggagacgtgtaaggtgtgcagcaacagagttttctgcgacacaatgaactctctgacccttcccagcgaagtgaatctgtgtaatgtcgatatctttaaccctaaatatgactgcaagatcatgacctccaaaacagatgtgtctagctccgtcattaccagcctcggagccatcgtgtcttgttacggcaagacaaaatgcacggcttccaataagaacaaggggattatcaaaaccttcagcaatggatgtgactatgtttctaacaagggcgtggacacagtctccgtgggcaataccctgtactatgttaacaaacaggaggggcagagcctttacgtgaagggagagcccattatcaacttttatgatcctctggtcttcccctccgacgaatttgatgcctctatcagccaagtgaatgagaaaattaaccagtccctcgctttcatccggaagtctgacgaactgctgcacaatgtgaacgccggcaagagcacaaccaatattatgatcacgaccattatcattgttatcatcgtcattctcctgtcccttatcgccgtggggctgctcctgtactgcaaagctcgcagcacaccggtgaccctgtctaaggatcagctttccggaattaacaatatcgcgttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6191 - RNA, 1897 nt, synthetic construct
  misc_feature 1..1897: note = mRNA product Design c-5 comprising derived and/or modified sequence from HRSV(A2)__F_DSCav1_mut6 (opt6)
  source 1..1897: mol_type = other RNA
gggagagcggctcggccattttgtcccagtcagtccggaggctgcggctgcagaagtaccgcctgcggagtaactgcaaagaagcttaccatggaactattaatcttaaaagcaaatgctataaccacaatattaacagcagtaacattctgttttgcctccggacaaaacataacagaagaattttatcaatcaacatgctctgcagtatccaaaggttacttaggcgcactacgcactggatggtatacatcagtaataacaatagaactatcaaacataaaagaaaataaatgtaacggtactgacgcaaaagtgaaactaattaaacaagaactcgacaaatacaaaaatgctgtaacagacctacaaatgctaatgtgctcaacacccgcaaccggatcaggatcagccatagcctccggagtcgcagtatgcaaagtattacatcttgaaggagaagtaaataaaataaaatcagcattactatccacaaataaagccgtagtatcactatcaaacggtgtatccgtccttacattcaaagtattagatctaaaaaactacatagataaacaactactacccatcttaaacaaacaatcatgctcaattcccaacccagaaacagtcatggaatttcaacaaaaaaacaacagactcttagaaataacacgagaattttcagtaaacgcaggagtaaccacaccagtaagtacatacatgctcaccaactcagaattattatcacttattaacgacatgccaattacaaacgaccaaaaaaaattaatgtcaaacaatgtccaaattgttagacaacaatcatactctataatgtgtataataaaagaagaagtactagcttacgtagttcaattaccactatatggcgtaatagatacaccttgctggaaactacatacatctccattatgtacaactaacacaaaagaaggatctaacatatgcctaacacgcacagatcgaggatggtactgcgataatgcaggttccgtatcattctttccacaagcagaaacatgtaaagtatgctcaaacagagtattctgtgacactatgaactccttaaccctaccctcagaagtcaatctatgcaacgttgacatatttaacccaaaatacgactgtaaaatcatgacatctaaaacagacgtatcatcatcagttattacatccctaggagcaatagtatcttgctacggaaaaacaaaatgtacagcatccaacaaaaacaaaggaataatcaaaacattctcaaacggctgcgactacgtatcaaacaaaggtgtagacacagtatcagtaggaaatactttatattacgtaaataaacaagaaggacaatctctatacgttaaaggcgaacctattataaacttctacgacccactcgtattcccttcagacgaatttgacgcatctatatcccaagttaacgaaaaaatcaaccaatcattagcctttataagaaaatccgacgaattattacataacgtcaacgctggaaaatcaacaactaacataatgataaccacaataataatagtcatcatagttatattactaagtctaatagccgtaggcctcctactttattgcaaagcaagatcaacaccagtaacattatccaaagaccaactcagcggcataaacaatatagctttttcaaactagggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6192 - RNA, 1897 nt, synthetic construct
  misc_feature 1..1897: note = mRNA product Design c-5 comprising derived and/or modified sequence from HRSV(A2)__F_DSCav1_mut6 (opt11)
  source 1..1897: mol_type = other RNA
gggagagcggctcggccattttgtcccagtcagtccggaggctgcggctgcagaagtaccgcctgcggagtaactgcaaagaagcttaccatggaactcctcatcctcaaagccaacgcaatcacaaccatactaactgcagttactttctgcttcgcatccggccaaaacatcaccgaagagttctaccaatcaacctgctccgcagtctccaaaggatacctcggagcccttcgcaccggctggtacacctccgtcataaccatcgaactctcaaacataaaagaaaacaaatgcaacggcacagacgcgaaagtcaaacttatcaaacaagaactcgacaaatacaaaaacgccgtcaccgacctgcagatgctcatgtgctcaacccccgccacaggaagcggctctgctatcgcttccggcgtcgccgtctgcaaagtcctccacctcgaaggcgaagtaaacaaaatcaagtcagccctcctctccaccaacaaagccgtcgtctctctctcaaacggcgtatccgtcctcacattcaaagtcctcgacctcaaaaactacatcgacaaacaacttctccccatcctaaacaaacaatcatgctccatccccaaccccgaaacagtcatggaatttcaacaaaagaacaaccgcctcttagaaatcacccgagaattttccgtcaacgcgggagtcacaacccccgtttctacgtatatgctcaccaactccgaactcctttccctcataaacgacatgccaatcaccaacgaccaaaagaaactcatgtcaaacaacgtccaaatcgtccgacaacaatcctactctattatgtgcatcatcaaagaagaagttctcgcctacgtcgtccaactacccctctacggcgtgatcgacaccccctgctggaaactacacacctcacccctctgcaccaccaacaccaaggaaggctccaacatctgcctcacccgcaccgaccgcggctggtactgcgacaacgctggctccgtctcattcttcccgcaagccgaaacttgcaaagtatgctccaacagagtattctgcgacaccatgaactcactaaccctcccttccgaagtcaacctttgcaacgttgacatattcaacccaaagtacgattgcaaaattatgacatccaaaacagatgtctcctcctccgtcatcacatccctcggtgccattgtatcatgctacggaaaaaccaaatgcaccgcatccaacaaaaacaaaggaatcatcaaaaccttctcaaacggctgcgattacgtctcaaacaaaggagtcgacacagtctccgtcggaaacaccctatactacgtcaacaaacaagaaggccaatccctgtacgtcaaaggagaacccatcatcaacttctacgaccccctcgtcttcccgagcgacgagttcgacgcctccatctcacaagtcaatgaaaagatcaaccaatcccttgccttcatccggaaatcggacgaactcctacacaacgtgaacgctggaaaatcaaccaccaacatcatgatcacaaccatcattatcgtcatcatcgtcatactcctctccctaatcgccgtcggcctcctcctgtattgcaaagctcgctccacccccgtcaccctgtccaaagaccaactctccggaatcaacaacatcgccttctcaaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6193 - RNA, 1906 nt, synthetic construct
  misc_feature 1..1906: note = mRNA product Design d-1 comprising derived and/or modified sequence from HRSV(A2)__F_DSCav1_mut6 (opt1)
  source 1..1906: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaaccccgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6194 - RNA, 1906 nt, synthetic construct
  misc_feature 1..1906: note = mRNA product Design d-1 comprising derived and/or modified sequence from HRSV(A2)__F_DSCav1_mut6 (opt1)
  source 1..1906: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctcatgtgcagcacccccgccaccgggtccggcagcgccatcgcctccggcgtggcggtgtgcaaggtcctgcacctggagggggaggtgaacaagatcaagagcgccctcctgtccaccaacaaggccgtggtcagcctgtccaacggcgtgagcgtgctcacgttcaaggtcctggacctgaagaactacatcgacaagcagctcctgccgatcctgaacaagcagtcctgcagcatccccaaccccgagaccgtgatggagttccagcagaagaacaaccggctcctggagatcacccgcgagttctccgtgaacgccggggtcaccacgcccgtgagcacctacatgctgaccaactccgagctcctgagcctgatcaacgacatgccgatcaccaacgaccagaagaagctcatgagcaacaacgtgcagatcgtccggcagcagtcctacagcatcatgtgcatcatcaaggaggaggtgctggcctacgtggtccagctgcccctctacggcgtgatcgacacgccctgctggaagctgcacaccagccccctgtgcaccaccaacacgaaggaggggagcaacatctgcctcacccgcaccgaccggggctggtactgcgacaacgcgggctccgtgagcttcttcccgcaggccgagacctgcaaggtctgctccaaccgcgtgttctgcgacacgatgaacagcctgaccctgccctccgaggtcaacctctgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaacaaggggatcatcaagaccttctccaacggctgcgactacgtgagcaacaagggcgtcgacacggtgtccgtggggaacaccctgtactacgtcaacaagcaggagggccagagcctctacgtgaagggggagcccatcatcaacttctacgacccgctggtgttccccagcgacgagttcgacgcctccatcagccaggtcaacgagaagatcaaccagtccctggcgttcatccggaagtccgacgagctcctgcacaacgtgaacgccggcaagtccaccaccaacatcatgatcaccacgatcatcatcgtgatcatcgtcatcctgctcagcctgatcgccgtggggctgctcctgtactgcaaggcccgctccacccccgtgaccctgagcaaggaccagctgtccggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6195 - RNA, 1906 nt, synthetic construct
  misc_feature 1..1906: note = mRNA product Design d-1 comprising derived and/or modified sequence from HRSV(A2)__F_DSCav1_mut6 (opt2)
  source 1..1906: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6196 - RNA, 1906 nt, synthetic construct
  misc_feature 1..1906: note = mRNA product Design d-1 comprising derived and/or modified sequence from HRSV(A2)__F_DSCav1_mut6 (opt3)
  source 1..1906: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagatgcttatgtgttccacacccgccaccgggtctggatcggctatagcatcaggcgtggccgtctgcaaggtgctgcacttggagggtgaggttaacaaaatcaagagcgctctcctgagtacgaataaagccgtggtctccctgtctaacggggtgagcgtactcacttttaaggttttagatctgaagaattacattgacaaacagcttttgcctatcctgaacaagcaatcctgttcaattccaaatccggaaaccgtgatggagttccagcagaaaaacaataggctactcgaaatcacacgggagtttagtgtcaacgcgggagtgactacccccgtgagcacatatatgctgaccaattctgagcttctgtccttgataaacgatatgcctattacgaacgaccagaagaaactcatgtcaaataacgtccaaatcgttcgccagcagagctacagtattatgtgcatcatcaaggaagaggtgctggcatatgtagtgcagttaccactgtacggcgtcattgatactccctgttggaaactccatacatctcctctttgcaccactaatacaaaggaaggctccaacatatgtctgacccgaacggaccgtgggtggtactgcgataatgccggaagcgtgtcgttctttccacaagctgagacctgtaaggtttgctctaacagagtgttctgcgacacaatgaactccttgactctaccctcagaagtcaatctgtgtaatgtggatatctttaaccctaaatatgactgcaagattatgaccagtaaaacagatgtaagctcctctgttatcactagcctcggtgccatagtgtcatgttacggcaagaccaaatgcacagcaagtaataagaacaaggggattatcaaaaccttctccaatggatgtgactatgtcagcaacaagggcgtggacactgtctctgtgggtaatacgctgtactatgttaacaaacaggaggggcagtcactttacgtgaagggagagccaatcattaacttttatgatccgctggtattccccagtgacgaatttgatgctagcatctcccaagtcaatgagaaaattaaccagtctttggccttcataaggaagtcggacgaactcctgcacaatgtgaacgcgggcaagagcacaaccaatatcatgattactaccatcatcattgttataatcgtgattttactgtccctaatcgccgtcggcctcctgctttactgcaaagcacggtcaacacctgtgaccttgagtaaggatcagctgtctgggattaacaatatcgctttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6197 - RNA, 1906 nt, synthetic construct
  misc_feature 1..1906: note = mRNA product Design d-1 comprising derived and/or modified sequence from HRSV(A2)__F_DSCav1_mut6 (opt4)
  source 1..1906: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6198 - RNA, 1906 nt, synthetic construct
  misc_feature 1..1906: note = mRNA product Design d-1 comprising derived and/or modified sequence from HRSV(A2)__F_DSCav1_mut6 (opt5)
  source 1..1906: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagatgctgatgtgtagcacccccgccacaggatccggctctgctattgccagcggggtcgcggtgtgcaaggttctgcacctcgagggagaggtgaacaaaatcaagtccgccctgcttagcaccaataaagctgtcgtgtctctgtccaacggcgttagcgtgctcacatttaaggtcctggatcttaagaattacattgacaaacagctgctccctatcctgaacaagcaatcttgttccattccgaatcccgaaaccgtgatggagttccagcagaaaaacaatcggctgctcgaaatcacgcgcgagtttagcgtgaacgccggcgtcacaacccctgtttctacatatatgctgaccaattccgagcttctgagcctcattaacgatatgcccatcaccaacgaccagaagaaactgatgtccaataacgtgcaaatcgtgagacagcagtcttacagcattatgtgcatcattaaggaagaggtccttgcttatgtggttcagctgcctctctacggggtgatcgatacaccctgttggaaactgcatacgtcccctctgtgcaccacaaataccaaggaaggaagcaacatttgtctcacacggaccgaccgcggctggtactgcgataatgccgggtctgtctccttctttccgcaagcggagacgtgtaaggtgtgcagcaacagagttttctgcgacacaatgaactctctgacccttcccagcgaagtgaatctgtgtaatgtcgatatctttaaccctaaatatgactgcaagatcatgacctccaaaacagatgtgtctagctccgtcattaccagcctcggagccatcgtgtcttgttacggcaagacaaaatgcacggcttccaataagaacaaggggattatcaaaaccttcagcaatggatgtgactatgtttctaacaagggcgtggacacagtctccgtgggcaataccctgtactatgttaacaaacaggaggggcagagcctttacgtgaagggagagcccattatcaacttttatgatcctctggtcttcccctccgacgaatttgatgcctctatcagccaagtgaatgagaaaattaaccagtccctcgctttcatccggaagtctgacgaactgctgcacaatgtgaacgccggcaagagcacaaccaatattatgatcacgaccattatcattgttatcatcgtcattctcctgtcccttatcgccgtggggctgctcctgtactgcaaagctcgcagcacaccggtgaccctgtctaaggatcagctttccggaattaacaatatcgcgttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6199 - RNA, 1906 nt, synthetic construct
  misc_feature 1..1906: note = mRNA product Design d-1 comprising derived and/or modified sequence from HRSV(A2)__F_DSCav1_mut6 (opt6)
  source 1..1906: mol_type = other RNA
gggagacccgtgacccggaagttgtacggctacgcgactttccctcccacaaaccctcgcgcccttcctttcctacttgggcccggcagaaagcttaccatggaactattaatcttaaaagcaaatgctataaccacaatattaacagcagtaacattctgttttgcctccggacaaaacataacagaagaattttatcaatcaacatgctctgcagtatccaaaggttacttaggcgcactacgcactggatggtatacatcagtaataacaatagaactatcaaacataaaagaaaataaatgtaacggtactgacgcaaaagtgaaactaattaaacaagaactcgacaaatacaaaaatgctgtaacagacctacaaatgctaatgtgctcaacacccgcaaccggatcaggatcagccatagcctccggagtcgcagtatgcaaagtattacatcttgaaggagaagtaaataaaataaaatcagcattactatccacaaataaagccgtagtatcactatcaaacggtgtatccgtccttacattcaaagtattagatctaaaaaactacatagataaacaactactacccatcttaaacaaacaatcatgctcaattcccaacccagaaacagtcatggaatttcaacaaaaaaacaacagactcttagaaataacacgagaattttcagtaaacgcaggagtaaccacaccagtaagtacatacatgctcaccaactcagaattattatcacttattaacgacatgccaattacaaacgaccaaaaaaaattaatgtcaaacaatgtccaaattgttagacaacaatcatactctataatgtgtataataaaagaagaagtactagcttacgtagttcaattaccactatatggcgtaatagatacaccttgctggaaactacatacatctccattatgtacaactaacacaaaagaaggatctaacatatgcctaacacgcacagatcgaggatggtactgcgataatgcaggttccgtatcattctttccacaagcagaaacatgtaaagtatgctcaaacagagtattctgtgacactatgaactccttaaccctaccctcagaagtcaatctatgcaacgttgacatatttaacccaaaatacgactgtaaaatcatgacatctaaaacagacgtatcatcatcagttattacatccctaggagcaatagtatcttgctacggaaaaacaaaatgtacagcatccaacaaaaacaaaggaataatcaaaacattctcaaacggctgcgactacgtatcaaacaaaggtgtagacacagtatcagtaggaaatactttatattacgtaaataaacaagaaggacaatctctatacgttaaaggcgaacctattataaacttctacgacccactcgtattcccttcagacgaatttgacgcatctatatcccaagttaacgaaaaaatcaaccaatcattagcctttataagaaaatccgacgaattattacataacgtcaacgctggaaaatcaacaactaacataatgataaccacaataataatagtcatcatagttatattactaagtctaatagccgtaggcctcctactttattgcaaagcaagatcaacaccagtaacattatccaaagaccaactcagcggcataaacaatatagctttttcaaactagggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6200 - RNA, 1906 nt, synthetic construct
  misc_feature 1..1906: note = mRNA product Design d-1 comprising derived and/or modified sequence from HRSV(A2)__F_DSCav1_mut6 (opt11)
  source 1..1906: mol_type = other RNA
gggagacccgtgacccggaagttgtacggctacgcgactttccctcccacaaaccctcgcgcccttcctttcctacttgggcccggcagaaagcttaccatggaactcctcatcctcaaagccaacgcaatcacaaccatactaactgcagttactttctgcttcgcatccggccaaaacatcaccgaagagttctaccaatcaacctgctccgcagtctccaaaggatacctcggagcccttcgcaccggctggtacacctccgtcataaccatcgaactctcaaacataaaagaaaacaaatgcaacggcacagacgcgaaagtcaaacttatcaaacaagaactcgacaaatacaaaaacgccgtcaccgacctgcagatgctcatgtgctcaacccccgccacaggaagcggctctgctatcgcttccggcgtcgccgtctgcaaagtcctccacctcgaaggcgaagtaaacaaaatcaagtcagccctcctctccaccaacaaagccgtcgtctctctctcaaacggcgtatccgtcctcacattcaaagtcctcgacctcaaaaactacatcgacaaacaacttctccccatcctaaacaaacaatcatgctccatccccaaccccgaaacagtcatggaatttcaacaaaagaacaaccgcctcttagaaatcacccgagaattttccgtcaacgcgggagtcacaacccccgtttctacgtatatgctcaccaactccgaactcctttccctcataaacgacatgccaatcaccaacgaccaaaagaaactcatgtcaaacaacgtccaaatcgtccgacaacaatcctactctattatgtgcatcatcaaagaagaagttctcgcctacgtcgtccaactacccctctacggcgtgatcgacaccccctgctggaaactacacacctcacccctctgcaccaccaacaccaaggaaggctccaacatctgcctcacccgcaccgaccgcggctggtactgcgacaacgctggctccgtctcattcttcccgcaagccgaaacttgcaaagtatgctccaacagagtattctgcgacaccatgaactcactaaccctcccttccgaagtcaacctttgcaacgttgacatattcaacccaaagtacgattgcaaaattatgacatccaaaacagatgtctcctcctccgtcatcacatccctcggtgccattgtatcatgctacggaaaaaccaaatgcaccgcatccaacaaaaacaaaggaatcatcaaaaccttctcaaacggctgcgattacgtctcaaacaaaggagtcgacacagtctccgtcggaaacaccctatactacgtcaacaaacaagaaggccaatccctgtacgtcaaaggagaacccatcatcaacttctacgaccccctcgtcttcccgagcgacgagttcgacgcctccatctcacaagtcaatgaaaagatcaaccaatcccttgccttcatccggaaatcggacgaactcctacacaacgtgaacgctggaaaatcaaccaccaacatcatgatcacaaccatcattatcgtcatcatcgtcatactcctctccctaatcgccgtcggcctcctcctgtattgcaaagctcgctccacccccgtcaccctgtccaaagaccaactctccggaatcaacaacatcgccttctcaaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6201 - RNA, 1961 nt, synthetic construct
  misc_feature 1..1961: note = mRNA product Design d-2 comprising derived and/or modified sequence from HRSV(A2)__F_DSCav1_mut6 (opt1)
  source 1..1961: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaaccccgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6202 - RNA, 1961 nt, synthetic construct
  misc_feature 1..1961: note = mRNA product Design d-2 comprising derived and/or modified sequence from HRSV(A2)__F_DSCav1_mut6 (opt1)
  source 1..1961: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctcatgtgcagcacccccgccaccgggtccggcagcgccatcgcctccggcgtggcggtgtgcaaggtcctgcacctggagggggaggtgaacaagatcaagagcgccctcctgtccaccaacaaggccgtggtcagcctgtccaacggcgtgagcgtgctcacgttcaaggtcctggacctgaagaactacatcgacaagcagctcctgccgatcctgaacaagcagtcctgcagcatccccaaccccgagaccgtgatggagttccagcagaagaacaaccggctcctggagatcacccgcgagttctccgtgaacgccggggtcaccacgcccgtgagcacctacatgctgaccaactccgagctcctgagcctgatcaacgacatgccgatcaccaacgaccagaagaagctcatgagcaacaacgtgcagatcgtccggcagcagtcctacagcatcatgtgcatcatcaaggaggaggtgctggcctacgtggtccagctgcccctctacggcgtgatcgacacgccctgctggaagctgcacaccagccccctgtgcaccaccaacacgaaggaggggagcaacatctgcctcacccgcaccgaccggggctggtactgcgacaacgcgggctccgtgagcttcttcccgcaggccgagacctgcaaggtctgctccaaccgcgtgttctgcgacacgatgaacagcctgaccctgccctccgaggtcaacctctgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaacaaggggatcatcaagaccttctccaacggctgcgactacgtgagcaacaagggcgtcgacacggtgtccgtggggaacaccctgtactacgtcaacaagcaggagggccagagcctctacgtgaagggggagcccatcatcaacttctacgacccgctggtgttccccagcgacgagttcgacgcctccatcagccaggtcaacgagaagatcaaccagtccctggcgttcatccggaagtccgacgagctcctgcacaacgtgaacgccggcaagtccaccaccaacatcatgatcaccacgatcatcatcgtgatcatcgtcatcctgctcagcctgatcgccgtggggctgctcctgtactgcaaggcccgctccacccccgtgaccctgagcaaggaccagctgtccggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6203 - RNA, 1961 nt, synthetic construct
  misc_feature 1..1961: note = mRNA product Design d-2 comprising derived and/or modified sequence from HRSV(A2)__F_DSCav1_mut6 (opt2)
  source 1..1961: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6204 - RNA, 1961 nt, synthetic construct
  misc_feature 1..1961: note = mRNA product Design d-2 comprising derived and/or modified sequence from HRSV(A2)__F_DSCav1_mut6 (opt3)
  source 1..1961: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagatgcttatgtgttccacacccgccaccgggtctggatcggctatagcatcaggcgtggccgtctgcaaggtgctgcacttggagggtgaggttaacaaaatcaagagcgctctcctgagtacgaataaagccgtggtctccctgtctaacggggtgagcgtactcacttttaaggttttagatctgaagaattacattgacaaacagcttttgcctatcctgaacaagcaatcctgttcaattccaaatccggaaaccgtgatggagttccagcagaaaaacaataggctactcgaaatcacacgggagtttagtgtcaacgcgggagtgactacccccgtgagcacatatatgctgaccaattctgagcttctgtccttgataaacgatatgcctattacgaacgaccagaagaaactcatgtcaaataacgtccaaatcgttcgccagcagagctacagtattatgtgcatcatcaaggaagaggtgctggcatatgtagtgcagttaccactgtacggcgtcattgatactccctgttggaaactccatacatctcctctttgcaccactaatacaaaggaaggctccaacatatgtctgacccgaacggaccgtgggtggtactgcgataatgccggaagcgtgtcgttctttccacaagctgagacctgtaaggtttgctctaacagagtgttctgcgacacaatgaactccttgactctaccctcagaagtcaatctgtgtaatgtggatatctttaaccctaaatatgactgcaagattatgaccagtaaaacagatgtaagctcctctgttatcactagcctcggtgccatagtgtcatgttacggcaagaccaaatgcacagcaagtaataagaacaaggggattatcaaaaccttctccaatggatgtgactatgtcagcaacaagggcgtggacactgtctctgtgggtaatacgctgtactatgttaacaaacaggaggggcagtcactttacgtgaagggagagccaatcattaacttttatgatccgctggtattccccagtgacgaatttgatgctagcatctcccaagtcaatgagaaaattaaccagtctttggccttcataaggaagtcggacgaactcctgcacaatgtgaacgcgggcaagagcacaaccaatatcatgattactaccatcatcattgttataatcgtgattttactgtccctaatcgccgtcggcctcctgctttactgcaaagcacggtcaacacctgtgaccttgagtaaggatcagctgtctgggattaacaatatcgctttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6205 - RNA, 1961 nt, synthetic construct
  misc_feature 1..1961: note = mRNA product Design d-2 comprising derived and/or modified sequence from HRSV(A2)__F_DSCav1_mut6 (opt4)
  source 1..1961: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6206 - RNA, 1961 nt, synthetic construct
  misc_feature 1..1961: note = mRNA product Design d-2 comprising derived and/or modified sequence from HRSV(A2)__F_DSCav1_mut6 (opt5)
  source 1..1961: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagatgctgatgtgtagcacccccgccacaggatccggctctgctattgccagcggggtcgcggtgtgcaaggttctgcacctcgagggagaggtgaacaaaatcaagtccgccctgcttagcaccaataaagctgtcgtgtctctgtccaacggcgttagcgtgctcacatttaaggtcctggatcttaagaattacattgacaaacagctgctccctatcctgaacaagcaatcttgttccattccgaatcccgaaaccgtgatggagttccagcagaaaaacaatcggctgctcgaaatcacgcgcgagtttagcgtgaacgccggcgtcacaacccctgtttctacatatatgctgaccaattccgagcttctgagcctcattaacgatatgcccatcaccaacgaccagaagaaactgatgtccaataacgtgcaaatcgtgagacagcagtcttacagcattatgtgcatcattaaggaagaggtccttgcttatgtggttcagctgcctctctacggggtgatcgatacaccctgttggaaactgcatacgtcccctctgtgcaccacaaataccaaggaaggaagcaacatttgtctcacacggaccgaccgcggctggtactgcgataatgccgggtctgtctccttctttccgcaagcggagacgtgtaaggtgtgcagcaacagagttttctgcgacacaatgaactctctgacccttcccagcgaagtgaatctgtgtaatgtcgatatctttaaccctaaatatgactgcaagatcatgacctccaaaacagatgtgtctagctccgtcattaccagcctcggagccatcgtgtcttgttacggcaagacaaaatgcacggcttccaataagaacaaggggattatcaaaaccttcagcaatggatgtgactatgtttctaacaagggcgtggacacagtctccgtgggcaataccctgtactatgttaacaaacaggaggggcagagcctttacgtgaagggagagcccattatcaacttttatgatcctctggtcttcccctccgacgaatttgatgcctctatcagccaagtgaatgagaaaattaaccagtccctcgctttcatccggaagtctgacgaactgctgcacaatgtgaacgccggcaagagcacaaccaatattatgatcacgaccattatcattgttatcatcgtcattctcctgtcccttatcgccgtggggctgctcctgtactgcaaagctcgcagcacaccggtgaccctgtctaaggatcagctttccggaattaacaatatcgcgttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6207 - RNA, 1961 nt, synthetic construct
  misc_feature 1..1961: note = mRNA product Design d-2 comprising derived and/or modified sequence from HRSV(A2)__F_DSCav1_mut6 (opt6)
  source 1..1961: mol_type = other RNA
gggagagcggctcggccattttgtcccagtcagtccggaggctgcggctgcagaagtaccgcctgcggagtaactgcaaagaagcttaccatggaactattaatcttaaaagcaaatgctataaccacaatattaacagcagtaacattctgttttgcctccggacaaaacataacagaagaattttatcaatcaacatgctctgcagtatccaaaggttacttaggcgcactacgcactggatggtatacatcagtaataacaatagaactatcaaacataaaagaaaataaatgtaacggtactgacgcaaaagtgaaactaattaaacaagaactcgacaaatacaaaaatgctgtaacagacctacaaatgctaatgtgctcaacacccgcaaccggatcaggatcagccatagcctccggagtcgcagtatgcaaagtattacatcttgaaggagaagtaaataaaataaaatcagcattactatccacaaataaagccgtagtatcactatcaaacggtgtatccgtccttacattcaaagtattagatctaaaaaactacatagataaacaactactacccatcttaaacaaacaatcatgctcaattcccaacccagaaacagtcatggaatttcaacaaaaaaacaacagactcttagaaataacacgagaattttcagtaaacgcaggagtaaccacaccagtaagtacatacatgctcaccaactcagaattattatcacttattaacgacatgccaattacaaacgaccaaaaaaaattaatgtcaaacaatgtccaaattgttagacaacaatcatactctataatgtgtataataaaagaagaagtactagcttacgtagttcaattaccactatatggcgtaatagatacaccttgctggaaactacatacatctccattatgtacaactaacacaaaagaaggatctaacatatgcctaacacgcacagatcgaggatggtactgcgataatgcaggttccgtatcattctttccacaagcagaaacatgtaaagtatgctcaaacagagtattctgtgacactatgaactccttaaccctaccctcagaagtcaatctatgcaacgttgacatatttaacccaaaatacgactgtaaaatcatgacatctaaaacagacgtatcatcatcagttattacatccctaggagcaatagtatcttgctacggaaaaacaaaatgtacagcatccaacaaaaacaaaggaataatcaaaacattctcaaacggctgcgactacgtatcaaacaaaggtgtagacacagtatcagtaggaaatactttatattacgtaaataaacaagaaggacaatctctatacgttaaaggcgaacctattataaacttctacgacccactcgtattcccttcagacgaatttgacgcatctatatcccaagttaacgaaaaaatcaaccaatcattagcctttataagaaaatccgacgaattattacataacgtcaacgctggaaaatcaacaactaacataatgataaccacaataataatagtcatcatagttatattactaagtctaatagccgtaggcctcctactttattgcaaagcaagatcaacaccagtaacattatccaaagaccaactcagcggcataaacaatatagctttttcaaactagggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6208 - RNA, 1961 nt, synthetic construct
  misc_feature 1..1961: note = mRNA product Design d-2 comprising derived and/or modified sequence from HRSV(A2)__F_DSCav1_mut6 (opt11)
  source 1..1961: mol_type = other RNA
gggagagcggctcggccattttgtcccagtcagtccggaggctgcggctgcagaagtaccgcctgcggagtaactgcaaagaagcttaccatggaactcctcatcctcaaagccaacgcaatcacaaccatactaactgcagttactttctgcttcgcatccggccaaaacatcaccgaagagttctaccaatcaacctgctccgcagtctccaaaggatacctcggagcccttcgcaccggctggtacacctccgtcataaccatcgaactctcaaacataaaagaaaacaaatgcaacggcacagacgcgaaagtcaaacttatcaaacaagaactcgacaaatacaaaaacgccgtcaccgacctgcagatgctcatgtgctcaacccccgccacaggaagcggctctgctatcgcttccggcgtcgccgtctgcaaagtcctccacctcgaaggcgaagtaaacaaaatcaagtcagccctcctctccaccaacaaagccgtcgtctctctctcaaacggcgtatccgtcctcacattcaaagtcctcgacctcaaaaactacatcgacaaacaacttctccccatcctaaacaaacaatcatgctccatccccaaccccgaaacagtcatggaatttcaacaaaagaacaaccgcctcttagaaatcacccgagaattttccgtcaacgcgggagtcacaacccccgtttctacgtatatgctcaccaactccgaactcctttccctcataaacgacatgccaatcaccaacgaccaaaagaaactcatgtcaaacaacgtccaaatcgtccgacaacaatcctactctattatgtgcatcatcaaagaagaagttctcgcctacgtcgtccaactacccctctacggcgtgatcgacaccccctgctggaaactacacacctcacccctctgcaccaccaacaccaaggaaggctccaacatctgcctcacccgcaccgaccgcggctggtactgcgacaacgctggctccgtctcattcttcccgcaagccgaaacttgcaaagtatgctccaacagagtattctgcgacaccatgaactcactaaccctcccttccgaagtcaacctttgcaacgttgacatattcaacccaaagtacgattgcaaaattatgacatccaaaacagatgtctcctcctccgtcatcacatccctcggtgccattgtatcatgctacggaaaaaccaaatgcaccgcatccaacaaaaacaaaggaatcatcaaaaccttctcaaacggctgcgattacgtctcaaacaaaggagtcgacacagtctccgtcggaaacaccctatactacgtcaacaaacaagaaggccaatccctgtacgtcaaaggagaacccatcatcaacttctacgaccccctcgtcttcccgagcgacgagttcgacgcctccatctcacaagtcaatgaaaagatcaaccaatcccttgccttcatccggaaatcggacgaactcctacacaacgtgaacgctggaaaatcaaccaccaacatcatgatcacaaccatcattatcgtcatcatcgtcatactcctctccctaatcgccgtcggcctcctcctgtattgcaaagctcgctccacccccgtcaccctgtccaaagaccaactctccggaatcaacaacatcgccttctcaaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6209 - RNA, 2277 nt, synthetic construct
  misc_feature 1..2277: note = mRNA product Design d-3 comprising derived and/or modified sequence from HRSV(A2)__F_DSCav1_mut6 (opt1)
  source 1..2277: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaaccccgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6210 - RNA, 2277 nt, synthetic construct
  misc_feature 1..2277: note = mRNA product Design d-3 comprising derived and/or modified sequence from HRSV(A2)__F_DSCav1_mut6 (opt1)
  source 1..2277: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctcatgtgcagcacccccgccaccgggtccggcagcgccatcgcctccggcgtggcggtgtgcaaggtcctgcacctggagggggaggtgaacaagatcaagagcgccctcctgtccaccaacaaggccgtggtcagcctgtccaacggcgtgagcgtgctcacgttcaaggtcctggacctgaagaactacatcgacaagcagctcctgccgatcctgaacaagcagtcctgcagcatccccaaccccgagaccgtgatggagttccagcagaagaacaaccggctcctggagatcacccgcgagttctccgtgaacgccggggtcaccacgcccgtgagcacctacatgctgaccaactccgagctcctgagcctgatcaacgacatgccgatcaccaacgaccagaagaagctcatgagcaacaacgtgcagatcgtccggcagcagtcctacagcatcatgtgcatcatcaaggaggaggtgctggcctacgtggtccagctgcccctctacggcgtgatcgacacgccctgctggaagctgcacaccagccccctgtgcaccaccaacacgaaggaggggagcaacatctgcctcacccgcaccgaccggggctggtactgcgacaacgcgggctccgtgagcttcttcccgcaggccgagacctgcaaggtctgctccaaccgcgtgttctgcgacacgatgaacagcctgaccctgccctccgaggtcaacctctgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaacaaggggatcatcaagaccttctccaacggctgcgactacgtgagcaacaagggcgtcgacacggtgtccgtggggaacaccctgtactacgtcaacaagcaggagggccagagcctctacgtgaagggggagcccatcatcaacttctacgacccgctggtgttccccagcgacgagttcgacgcctccatcagccaggtcaacgagaagatcaaccagtccctggcgttcatccggaagtccgacgagctcctgcacaacgtgaacgccggcaagtccaccaccaacatcatgatcaccacgatcatcatcgtgatcatcgtcatcctgctcagcctgatcgccgtggggctgctcctgtactgcaaggcccgctccacccccgtgaccctgagcaaggaccagctgtccggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6211 - RNA, 2277 nt, synthetic construct
  misc_feature 1..2277: note = mRNA product Design d-3 comprising derived and/or modified sequence from HRSV(A2)__F_DSCav1_mut6 (opt2)
  source 1..2277: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6212 - RNA, 2277 nt, synthetic construct
  misc_feature 1..2277: note = mRNA product Design d-3 comprising derived and/or modified sequence from HRSV(A2)__F_DSCav1_mut6 (opt3)
  source 1..2277: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagatgcttatgtgttccacacccgccaccgggtctggatcggctatagcatcaggcgtggccgtctgcaaggtgctgcacttggagggtgaggttaacaaaatcaagagcgctctcctgagtacgaataaagccgtggtctccctgtctaacggggtgagcgtactcacttttaaggttttagatctgaagaattacattgacaaacagcttttgcctatcctgaacaagcaatcctgttcaattccaaatccggaaaccgtgatggagttccagcagaaaaacaataggctactcgaaatcacacgggagtttagtgtcaacgcgggagtgactacccccgtgagcacatatatgctgaccaattctgagcttctgtccttgataaacgatatgcctattacgaacgaccagaagaaactcatgtcaaataacgtccaaatcgttcgccagcagagctacagtattatgtgcatcatcaaggaagaggtgctggcatatgtagtgcagttaccactgtacggcgtcattgatactccctgttggaaactccatacatctcctctttgcaccactaatacaaaggaaggctccaacatatgtctgacccgaacggaccgtgggtggtactgcgataatgccggaagcgtgtcgttctttccacaagctgagacctgtaaggtttgctctaacagagtgttctgcgacacaatgaactccttgactctaccctcagaagtcaatctgtgtaatgtggatatctttaaccctaaatatgactgcaagattatgaccagtaaaacagatgtaagctcctctgttatcactagcctcggtgccatagtgtcatgttacggcaagaccaaatgcacagcaagtaataagaacaaggggattatcaaaaccttctccaatggatgtgactatgtcagcaacaagggcgtggacactgtctctgtgggtaatacgctgtactatgttaacaaacaggaggggcagtcactttacgtgaagggagagccaatcattaacttttatgatccgctggtattccccagtgacgaatttgatgctagcatctcccaagtcaatgagaaaattaaccagtctttggccttcataaggaagtcggacgaactcctgcacaatgtgaacgcgggcaagagcacaaccaatatcatgattactaccatcatcattgttataatcgtgattttactgtccctaatcgccgtcggcctcctgctttactgcaaagcacggtcaacacctgtgaccttgagtaaggatcagctgtctgggattaacaatatcgctttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6213 - RNA, 2277 nt, synthetic construct
  misc_feature 1..2277: note = mRNA product Design d-3 comprising derived and/or modified sequence from HRSV(A2)__F_DSCav1_mut6 (opt4)
  source 1..2277: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6214 - RNA, 2277 nt, synthetic construct
  misc_feature 1..2277: note = mRNA product Design d-3 comprising derived and/or modified sequence from HRSV(A2)__F_DSCav1_mut6 (opt5)
  source 1..2277: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagatgctgatgtgtagcacccccgccacaggatccggctctgctattgccagcggggtcgcggtgtgcaaggttctgcacctcgagggagaggtgaacaaaatcaagtccgccctgcttagcaccaataaagctgtcgtgtctctgtccaacggcgttagcgtgctcacatttaaggtcctggatcttaagaattacattgacaaacagctgctccctatcctgaacaagcaatcttgttccattccgaatcccgaaaccgtgatggagttccagcagaaaaacaatcggctgctcgaaatcacgcgcgagtttagcgtgaacgccggcgtcacaacccctgtttctacatatatgctgaccaattccgagcttctgagcctcattaacgatatgcccatcaccaacgaccagaagaaactgatgtccaataacgtgcaaatcgtgagacagcagtcttacagcattatgtgcatcattaaggaagaggtccttgcttatgtggttcagctgcctctctacggggtgatcgatacaccctgttggaaactgcatacgtcccctctgtgcaccacaaataccaaggaaggaagcaacatttgtctcacacggaccgaccgcggctggtactgcgataatgccgggtctgtctccttctttccgcaagcggagacgtgtaaggtgtgcagcaacagagttttctgcgacacaatgaactctctgacccttcccagcgaagtgaatctgtgtaatgtcgatatctttaaccctaaatatgactgcaagatcatgacctccaaaacagatgtgtctagctccgtcattaccagcctcggagccatcgtgtcttgttacggcaagacaaaatgcacggcttccaataagaacaaggggattatcaaaaccttcagcaatggatgtgactatgtttctaacaagggcgtggacacagtctccgtgggcaataccctgtactatgttaacaaacaggaggggcagagcctttacgtgaagggagagcccattatcaacttttatgatcctctggtcttcccctccgacgaatttgatgcctctatcagccaagtgaatgagaaaattaaccagtccctcgctttcatccggaagtctgacgaactgctgcacaatgtgaacgccggcaagagcacaaccaatattatgatcacgaccattatcattgttatcatcgtcattctcctgtcccttatcgccgtggggctgctcctgtactgcaaagctcgcagcacaccggtgaccctgtctaaggatcagctttccggaattaacaatatcgcgttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6215 - RNA, 2277 nt, synthetic construct
  misc_feature 1..2277: note = mRNA product Design d-3 comprising derived and/or modified sequence from HRSV(A2)__F_DSCav1_mut6 (opt6)
  source 1..2277: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactattaatcttaaaagcaaatgctataaccacaatattaacagcagtaacattctgttttgcctccggacaaaacataacagaagaattttatcaatcaacatgctctgcagtatccaaaggttacttaggcgcactacgcactggatggtatacatcagtaataacaatagaactatcaaacataaaagaaaataaatgtaacggtactgacgcaaaagtgaaactaattaaacaagaactcgacaaatacaaaaatgctgtaacagacctacaaatgctaatgtgctcaacacccgcaaccggatcaggatcagccatagcctccggagtcgcagtatgcaaagtattacatcttgaaggagaagtaaataaaataaaatcagcattactatccacaaataaagccgtagtatcactatcaaacggtgtatccgtccttacattcaaagtattagatctaaaaaactacatagataaacaactactacccatcttaaacaaacaatcatgctcaattcccaacccagaaacagtcatggaatttcaacaaaaaaacaacagactcttagaaataacacgagaattttcagtaaacgcaggagtaaccacaccagtaagtacatacatgctcaccaactcagaattattatcacttattaacgacatgccaattacaaacgaccaaaaaaaattaatgtcaaacaatgtccaaattgttagacaacaatcatactctataatgtgtataataaaagaagaagtactagcttacgtagttcaattaccactatatggcgtaatagatacaccttgctggaaactacatacatctccattatgtacaactaacacaaaagaaggatctaacatatgcctaacacgcacagatcgaggatggtactgcgataatgcaggttccgtatcattctttccacaagcagaaacatgtaaagtatgctcaaacagagtattctgtgacactatgaactccttaaccctaccctcagaagtcaatctatgcaacgttgacatatttaacccaaaatacgactgtaaaatcatgacatctaaaacagacgtatcatcatcagttattacatccctaggagcaatagtatcttgctacggaaaaacaaaatgtacagcatccaacaaaaacaaaggaataatcaaaacattctcaaacggctgcgactacgtatcaaacaaaggtgtagacacagtatcagtaggaaatactttatattacgtaaataaacaagaaggacaatctctatacgttaaaggcgaacctattataaacttctacgacccactcgtattcccttcagacgaatttgacgcatctatatcccaagttaacgaaaaaatcaaccaatcattagcctttataagaaaatccgacgaattattacataacgtcaacgctggaaaatcaacaactaacataatgataaccacaataataatagtcatcatagttatattactaagtctaatagccgtaggcctcctactttattgcaaagcaagatcaacaccagtaacattatccaaagaccaactcagcggcataaacaatatagctttttcaaactagggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6216 - RNA, 2277 nt, synthetic construct
  misc_feature 1..2277: note = mRNA product Design d-3 comprising derived and/or modified sequence from HRSV(A2)__F_DSCav1_mut6 (opt11)
  source 1..2277: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcctcatcctcaaagccaacgcaatcacaaccatactaactgcagttactttctgcttcgcatccggccaaaacatcaccgaagagttctaccaatcaacctgctccgcagtctccaaaggatacctcggagcccttcgcaccggctggtacacctccgtcataaccatcgaactctcaaacataaaagaaaacaaatgcaacggcacagacgcgaaagtcaaacttatcaaacaagaactcgacaaatacaaaaacgccgtcaccgacctgcagatgctcatgtgctcaacccccgccacaggaagcggctctgctatcgcttccggcgtcgccgtctgcaaagtcctccacctcgaaggcgaagtaaacaaaatcaagtcagccctcctctccaccaacaaagccgtcgtctctctctcaaacggcgtatccgtcctcacattcaaagtcctcgacctcaaaaactacatcgacaaacaacttctccccatcctaaacaaacaatcatgctccatccccaaccccgaaacagtcatggaatttcaacaaaagaacaaccgcctcttagaaatcacccgagaattttccgtcaacgcgggagtcacaacccccgtttctacgtatatgctcaccaactccgaactcctttccctcataaacgacatgccaatcaccaacgaccaaaagaaactcatgtcaaacaacgtccaaatcgtccgacaacaatcctactctattatgtgcatcatcaaagaagaagttctcgcctacgtcgtccaactacccctctacggcgtgatcgacaccccctgctggaaactacacacctcacccctctgcaccaccaacaccaaggaaggctccaacatctgcctcacccgcaccgaccgcggctggtactgcgacaacgctggctccgtctcattcttcccgcaagccgaaacttgcaaagtatgctccaacagagtattctgcgacaccatgaactcactaaccctcccttccgaagtcaacctttgcaacgttgacatattcaacccaaagtacgattgcaaaattatgacatccaaaacagatgtctcctcctccgtcatcacatccctcggtgccattgtatcatgctacggaaaaaccaaatgcaccgcatccaacaaaaacaaaggaatcatcaaaaccttctcaaacggctgcgattacgtctcaaacaaaggagtcgacacagtctccgtcggaaacaccctatactacgtcaacaaacaagaaggccaatccctgtacgtcaaaggagaacccatcatcaacttctacgaccccctcgtcttcccgagcgacgagttcgacgcctccatctcacaagtcaatgaaaagatcaaccaatcccttgccttcatccggaaatcggacgaactcctacacaacgtgaacgctggaaaatcaaccaccaacatcatgatcacaaccatcattatcgtcatcatcgtcatactcctctccctaatcgccgtcggcctcctcctgtattgcaaagctcgctccacccccgtcaccctgtccaaagaccaactctccggaatcaacaacatcgccttctcaaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6217 - RNA, 1960 nt, synthetic construct
  misc_feature 1..1960: note = mRNA product Design d-4 comprising derived and/or modified sequence from HRSV(A2)__F_DSCav1_mut6 (opt1)
  source 1..1960: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaaccccgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6218 - RNA, 1960 nt, synthetic construct
  misc_feature 1..1960: note = mRNA product Design d-4 comprising derived and/or modified sequence from HRSV(A2)__F_DSCav1_mut6 (opt1)
  source 1..1960: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctcatgtgcagcacccccgccaccgggtccggcagcgccatcgcctccggcgtggcggtgtgcaaggtcctgcacctggagggggaggtgaacaagatcaagagcgccctcctgtccaccaacaaggccgtggtcagcctgtccaacggcgtgagcgtgctcacgttcaaggtcctggacctgaagaactacatcgacaagcagctcctgccgatcctgaacaagcagtcctgcagcatccccaaccccgagaccgtgatggagttccagcagaagaacaaccggctcctggagatcacccgcgagttctccgtgaacgccggggtcaccacgcccgtgagcacctacatgctgaccaactccgagctcctgagcctgatcaacgacatgccgatcaccaacgaccagaagaagctcatgagcaacaacgtgcagatcgtccggcagcagtcctacagcatcatgtgcatcatcaaggaggaggtgctggcctacgtggtccagctgcccctctacggcgtgatcgacacgccctgctggaagctgcacaccagccccctgtgcaccaccaacacgaaggaggggagcaacatctgcctcacccgcaccgaccggggctggtactgcgacaacgcgggctccgtgagcttcttcccgcaggccgagacctgcaaggtctgctccaaccgcgtgttctgcgacacgatgaacagcctgaccctgccctccgaggtcaacctctgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaacaaggggatcatcaagaccttctccaacggctgcgactacgtgagcaacaagggcgtcgacacggtgtccgtggggaacaccctgtactacgtcaacaagcaggagggccagagcctctacgtgaagggggagcccatcatcaacttctacgacccgctggtgttccccagcgacgagttcgacgcctccatcagccaggtcaacgagaagatcaaccagtccctggcgttcatccggaagtccgacgagctcctgcacaacgtgaacgccggcaagtccaccaccaacatcatgatcaccacgatcatcatcgtgatcatcgtcatcctgctcagcctgatcgccgtggggctgctcctgtactgcaaggcccgctccacccccgtgaccctgagcaaggaccagctgtccggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6219 - RNA, 1960 nt, synthetic construct
  misc_feature 1..1960: note = mRNA product Design d-4 comprising derived and/or modified sequence from HRSV(A2)__F_DSCav1_mut6 (opt2)
  source 1..1960: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6220 - RNA, 1960 nt, synthetic construct
  misc_feature 1..1960: note = mRNA product Design d-4 comprising derived and/or modified sequence from HRSV(A2)__F_DSCav1_mut6 (opt3)
  source 1..1960: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagatgcttatgtgttccacacccgccaccgggtctggatcggctatagcatcaggcgtggccgtctgcaaggtgctgcacttggagggtgaggttaacaaaatcaagagcgctctcctgagtacgaataaagccgtggtctccctgtctaacggggtgagcgtactcacttttaaggttttagatctgaagaattacattgacaaacagcttttgcctatcctgaacaagcaatcctgttcaattccaaatccggaaaccgtgatggagttccagcagaaaaacaataggctactcgaaatcacacgggagtttagtgtcaacgcgggagtgactacccccgtgagcacatatatgctgaccaattctgagcttctgtccttgataaacgatatgcctattacgaacgaccagaagaaactcatgtcaaataacgtccaaatcgttcgccagcagagctacagtattatgtgcatcatcaaggaagaggtgctggcatatgtagtgcagttaccactgtacggcgtcattgatactccctgttggaaactccatacatctcctctttgcaccactaatacaaaggaaggctccaacatatgtctgacccgaacggaccgtgggtggtactgcgataatgccggaagcgtgtcgttctttccacaagctgagacctgtaaggtttgctctaacagagtgttctgcgacacaatgaactccttgactctaccctcagaagtcaatctgtgtaatgtggatatctttaaccctaaatatgactgcaagattatgaccagtaaaacagatgtaagctcctctgttatcactagcctcggtgccatagtgtcatgttacggcaagaccaaatgcacagcaagtaataagaacaaggggattatcaaaaccttctccaatggatgtgactatgtcagcaacaagggcgtggacactgtctctgtgggtaatacgctgtactatgttaacaaacaggaggggcagtcactttacgtgaagggagagccaatcattaacttttatgatccgctggtattccccagtgacgaatttgatgctagcatctcccaagtcaatgagaaaattaaccagtctttggccttcataaggaagtcggacgaactcctgcacaatgtgaacgcgggcaagagcacaaccaatatcatgattactaccatcatcattgttataatcgtgattttactgtccctaatcgccgtcggcctcctgctttactgcaaagcacggtcaacacctgtgaccttgagtaaggatcagctgtctgggattaacaatatcgctttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6221 - RNA, 1960 nt, synthetic construct
  misc_feature 1..1960: note = mRNA product Design d-4 comprising derived and/or modified sequence from HRSV(A2)__F_DSCav1_mut6 (opt4)
  source 1..1960: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6222 - RNA, 1960 nt, synthetic construct
  misc_feature 1..1960: note = mRNA product Design d-4 comprising derived and/or modified sequence from HRSV(A2)__F_DSCav1_mut6 (opt5)
  source 1..1960: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagatgctgatgtgtagcacccccgccacaggatccggctctgctattgccagcggggtcgcggtgtgcaaggttctgcacctcgagggagaggtgaacaaaatcaagtccgccctgcttagcaccaataaagctgtcgtgtctctgtccaacggcgttagcgtgctcacatttaaggtcctggatcttaagaattacattgacaaacagctgctccctatcctgaacaagcaatcttgttccattccgaatcccgaaaccgtgatggagttccagcagaaaaacaatcggctgctcgaaatcacgcgcgagtttagcgtgaacgccggcgtcacaacccctgtttctacatatatgctgaccaattccgagcttctgagcctcattaacgatatgcccatcaccaacgaccagaagaaactgatgtccaataacgtgcaaatcgtgagacagcagtcttacagcattatgtgcatcattaaggaagaggtccttgcttatgtggttcagctgcctctctacggggtgatcgatacaccctgttggaaactgcatacgtcccctctgtgcaccacaaataccaaggaaggaagcaacatttgtctcacacggaccgaccgcggctggtactgcgataatgccgggtctgtctccttctttccgcaagcggagacgtgtaaggtgtgcagcaacagagttttctgcgacacaatgaactctctgacccttcccagcgaagtgaatctgtgtaatgtcgatatctttaaccctaaatatgactgcaagatcatgacctccaaaacagatgtgtctagctccgtcattaccagcctcggagccatcgtgtcttgttacggcaagacaaaatgcacggcttccaataagaacaaggggattatcaaaaccttcagcaatggatgtgactatgtttctaacaagggcgtggacacagtctccgtgggcaataccctgtactatgttaacaaacaggaggggcagagcctttacgtgaagggagagcccattatcaacttttatgatcctctggtcttcccctccgacgaatttgatgcctctatcagccaagtgaatgagaaaattaaccagtccctcgctttcatccggaagtctgacgaactgctgcacaatgtgaacgccggcaagagcacaaccaatattatgatcacgaccattatcattgttatcatcgtcattctcctgtcccttatcgccgtggggctgctcctgtactgcaaagctcgcagcacaccggtgaccctgtctaaggatcagctttccggaattaacaatatcgcgttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6223 - RNA, 1960 nt, synthetic construct
  misc_feature 1..1960: note = mRNA product Design d-4 comprising derived and/or modified sequence from HRSV(A2)__F_DSCav1_mut6 (opt6)
  source 1..1960: mol_type = other RNA
gggagagtcccgcagtcggcgtccagcggctctgcttgttcgtgtgtgtgtcgttgcaggccttattcaagcttaccatggaactattaatcttaaaagcaaatgctataaccacaatattaacagcagtaacattctgttttgcctccggacaaaacataacagaagaattttatcaatcaacatgctctgcagtatccaaaggttacttaggcgcactacgcactggatggtatacatcagtaataacaatagaactatcaaacataaaagaaaataaatgtaacggtactgacgcaaaagtgaaactaattaaacaagaactcgacaaatacaaaaatgctgtaacagacctacaaatgctaatgtgctcaacacccgcaaccggatcaggatcagccatagcctccggagtcgcagtatgcaaagtattacatcttgaaggagaagtaaataaaataaaatcagcattactatccacaaataaagccgtagtatcactatcaaacggtgtatccgtccttacattcaaagtattagatctaaaaaactacatagataaacaactactacccatcttaaacaaacaatcatgctcaattcccaacccagaaacagtcatggaatttcaacaaaaaaacaacagactcttagaaataacacgagaattttcagtaaacgcaggagtaaccacaccagtaagtacatacatgctcaccaactcagaattattatcacttattaacgacatgccaattacaaacgaccaaaaaaaattaatgtcaaacaatgtccaaattgttagacaacaatcatactctataatgtgtataataaaagaagaagtactagcttacgtagttcaattaccactatatggcgtaatagatacaccttgctggaaactacatacatctccattatgtacaactaacacaaaagaaggatctaacatatgcctaacacgcacagatcgaggatggtactgcgataatgcaggttccgtatcattctttccacaagcagaaacatgtaaagtatgctcaaacagagtattctgtgacactatgaactccttaaccctaccctcagaagtcaatctatgcaacgttgacatatttaacccaaaatacgactgtaaaatcatgacatctaaaacagacgtatcatcatcagttattacatccctaggagcaatagtatcttgctacggaaaaacaaaatgtacagcatccaacaaaaacaaaggaataatcaaaacattctcaaacggctgcgactacgtatcaaacaaaggtgtagacacagtatcagtaggaaatactttatattacgtaaataaacaagaaggacaatctctatacgttaaaggcgaacctattataaacttctacgacccactcgtattcccttcagacgaatttgacgcatctatatcccaagttaacgaaaaaatcaaccaatcattagcctttataagaaaatccgacgaattattacataacgtcaacgctggaaaatcaacaactaacataatgataaccacaataataatagtcatcatagttatattactaagtctaatagccgtaggcctcctactttattgcaaagcaagatcaacaccagtaacattatccaaagaccaactcagcggcataaacaatatagctttttcaaactagggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6224 - RNA, 1960 nt, synthetic construct
  misc_feature 1..1960: note = mRNA product Design d-4 comprising derived and/or modified sequence from HRSV(A2)__F_DSCav1_mut6 (opt11)
  source 1..1960: mol_type = other RNA
gggagagtcccgcagtcggcgtccagcggctctgcttgttcgtgtgtgtgtcgttgcaggccttattcaagcttaccatggaactcctcatcctcaaagccaacgcaatcacaaccatactaactgcagttactttctgcttcgcatccggccaaaacatcaccgaagagttctaccaatcaacctgctccgcagtctccaaaggatacctcggagcccttcgcaccggctggtacacctccgtcataaccatcgaactctcaaacataaaagaaaacaaatgcaacggcacagacgcgaaagtcaaacttatcaaacaagaactcgacaaatacaaaaacgccgtcaccgacctgcagatgctcatgtgctcaacccccgccacaggaagcggctctgctatcgcttccggcgtcgccgtctgcaaagtcctccacctcgaaggcgaagtaaacaaaatcaagtcagccctcctctccaccaacaaagccgtcgtctctctctcaaacggcgtatccgtcctcacattcaaagtcctcgacctcaaaaactacatcgacaaacaacttctccccatcctaaacaaacaatcatgctccatccccaaccccgaaacagtcatggaatttcaacaaaagaacaaccgcctcttagaaatcacccgagaattttccgtcaacgcgggagtcacaacccccgtttctacgtatatgctcaccaactccgaactcctttccctcataaacgacatgccaatcaccaacgaccaaaagaaactcatgtcaaacaacgtccaaatcgtccgacaacaatcctactctattatgtgcatcatcaaagaagaagttctcgcctacgtcgtccaactacccctctacggcgtgatcgacaccccctgctggaaactacacacctcacccctctgcaccaccaacaccaaggaaggctccaacatctgcctcacccgcaccgaccgcggctggtactgcgacaacgctggctccgtctcattcttcccgcaagccgaaacttgcaaagtatgctccaacagagtattctgcgacaccatgaactcactaaccctcccttccgaagtcaacctttgcaacgttgacatattcaacccaaagtacgattgcaaaattatgacatccaaaacagatgtctcctcctccgtcatcacatccctcggtgccattgtatcatgctacggaaaaaccaaatgcaccgcatccaacaaaaacaaaggaatcatcaaaaccttctcaaacggctgcgattacgtctcaaacaaaggagtcgacacagtctccgtcggaaacaccctatactacgtcaacaaacaagaaggccaatccctgtacgtcaaaggagaacccatcatcaacttctacgaccccctcgtcttcccgagcgacgagttcgacgcctccatctcacaagtcaatgaaaagatcaaccaatcccttgccttcatccggaaatcggacgaactcctacacaacgtgaacgctggaaaatcaaccaccaacatcatgatcacaaccatcattatcgtcatcatcgtcatactcctctccctaatcgccgtcggcctcctcctgtattgcaaagctcgctccacccccgtcaccctgtccaaagaccaactctccggaatcaacaacatcgccttctcaaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6225 - RNA, 2057 nt, synthetic construct
  misc_feature 1..2057: note = mRNA product Design d-5 comprising derived and/or modified sequence from HRSV(A2)__F_DSCav1_mut6 (opt1)
  source 1..2057: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaaccccgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6226 - RNA, 2057 nt, synthetic construct
  misc_feature 1..2057: note = mRNA product Design d-5 comprising derived and/or modified sequence from HRSV(A2)__F_DSCav1_mut6 (opt1)
  source 1..2057: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctcatgtgcagcacccccgccaccgggtccggcagcgccatcgcctccggcgtggcggtgtgcaaggtcctgcacctggagggggaggtgaacaagatcaagagcgccctcctgtccaccaacaaggccgtggtcagcctgtccaacggcgtgagcgtgctcacgttcaaggtcctggacctgaagaactacatcgacaagcagctcctgccgatcctgaacaagcagtcctgcagcatccccaaccccgagaccgtgatggagttccagcagaagaacaaccggctcctggagatcacccgcgagttctccgtgaacgccggggtcaccacgcccgtgagcacctacatgctgaccaactccgagctcctgagcctgatcaacgacatgccgatcaccaacgaccagaagaagctcatgagcaacaacgtgcagatcgtccggcagcagtcctacagcatcatgtgcatcatcaaggaggaggtgctggcctacgtggtccagctgcccctctacggcgtgatcgacacgccctgctggaagctgcacaccagccccctgtgcaccaccaacacgaaggaggggagcaacatctgcctcacccgcaccgaccggggctggtactgcgacaacgcgggctccgtgagcttcttcccgcaggccgagacctgcaaggtctgctccaaccgcgtgttctgcgacacgatgaacagcctgaccctgccctccgaggtcaacctctgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaacaaggggatcatcaagaccttctccaacggctgcgactacgtgagcaacaagggcgtcgacacggtgtccgtggggaacaccctgtactacgtcaacaagcaggagggccagagcctctacgtgaagggggagcccatcatcaacttctacgacccgctggtgttccccagcgacgagttcgacgcctccatcagccaggtcaacgagaagatcaaccagtccctggcgttcatccggaagtccgacgagctcctgcacaacgtgaacgccggcaagtccaccaccaacatcatgatcaccacgatcatcatcgtgatcatcgtcatcctgctcagcctgatcgccgtggggctgctcctgtactgcaaggcccgctccacccccgtgaccctgagcaaggaccagctgtccggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6227 - RNA, 2057 nt, synthetic construct
  misc_feature 1..2057: note = mRNA product Design d-5 comprising derived and/or modified sequence from HRSV(A2)__F_DSCav1_mut6 (opt2)
  source 1..2057: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6228 - RNA, 2057 nt, synthetic construct
  misc_feature 1..2057: note = mRNA product Design d-5 comprising derived and/or modified sequence from HRSV(A2)__F_DSCav1_mut6 (opt3)
  source 1..2057: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagatgcttatgtgttccacacccgccaccgggtctggatcggctatagcatcaggcgtggccgtctgcaaggtgctgcacttggagggtgaggttaacaaaatcaagagcgctctcctgagtacgaataaagccgtggtctccctgtctaacggggtgagcgtactcacttttaaggttttagatctgaagaattacattgacaaacagcttttgcctatcctgaacaagcaatcctgttcaattccaaatccggaaaccgtgatggagttccagcagaaaaacaataggctactcgaaatcacacgggagtttagtgtcaacgcgggagtgactacccccgtgagcacatatatgctgaccaattctgagcttctgtccttgataaacgatatgcctattacgaacgaccagaagaaactcatgtcaaataacgtccaaatcgttcgccagcagagctacagtattatgtgcatcatcaaggaagaggtgctggcatatgtagtgcagttaccactgtacggcgtcattgatactccctgttggaaactccatacatctcctctttgcaccactaatacaaaggaaggctccaacatatgtctgacccgaacggaccgtgggtggtactgcgataatgccggaagcgtgtcgttctttccacaagctgagacctgtaaggtttgctctaacagagtgttctgcgacacaatgaactccttgactctaccctcagaagtcaatctgtgtaatgtggatatctttaaccctaaatatgactgcaagattatgaccagtaaaacagatgtaagctcctctgttatcactagcctcggtgccatagtgtcatgttacggcaagaccaaatgcacagcaagtaataagaacaaggggattatcaaaaccttctccaatggatgtgactatgtcagcaacaagggcgtggacactgtctctgtgggtaatacgctgtactatgttaacaaacaggaggggcagtcactttacgtgaagggagagccaatcattaacttttatgatccgctggtattccccagtgacgaatttgatgctagcatctcccaagtcaatgagaaaattaaccagtctttggccttcataaggaagtcggacgaactcctgcacaatgtgaacgcgggcaagagcacaaccaatatcatgattactaccatcatcattgttataatcgtgattttactgtccctaatcgccgtcggcctcctgctttactgcaaagcacggtcaacacctgtgaccttgagtaaggatcagctgtctgggattaacaatatcgctttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6229 - RNA, 2057 nt, synthetic construct
  misc_feature 1..2057: note = mRNA product Design d-5 comprising derived and/or modified sequence from HRSV(A2)__F_DSCav1_mut6 (opt4)
  source 1..2057: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6230 - RNA, 2057 nt, synthetic construct
  misc_feature 1..2057: note = mRNA product Design d-5 comprising derived and/or modified sequence from HRSV(A2)__F_DSCav1_mut6 (opt5)
  source 1..2057: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagatgctgatgtgtagcacccccgccacaggatccggctctgctattgccagcggggtcgcggtgtgcaaggttctgcacctcgagggagaggtgaacaaaatcaagtccgccctgcttagcaccaataaagctgtcgtgtctctgtccaacggcgttagcgtgctcacatttaaggtcctggatcttaagaattacattgacaaacagctgctccctatcctgaacaagcaatcttgttccattccgaatcccgaaaccgtgatggagttccagcagaaaaacaatcggctgctcgaaatcacgcgcgagtttagcgtgaacgccggcgtcacaacccctgtttctacatatatgctgaccaattccgagcttctgagcctcattaacgatatgcccatcaccaacgaccagaagaaactgatgtccaataacgtgcaaatcgtgagacagcagtcttacagcattatgtgcatcattaaggaagaggtccttgcttatgtggttcagctgcctctctacggggtgatcgatacaccctgttggaaactgcatacgtcccctctgtgcaccacaaataccaaggaaggaagcaacatttgtctcacacggaccgaccgcggctggtactgcgataatgccgggtctgtctccttctttccgcaagcggagacgtgtaaggtgtgcagcaacagagttttctgcgacacaatgaactctctgacccttcccagcgaagtgaatctgtgtaatgtcgatatctttaaccctaaatatgactgcaagatcatgacctccaaaacagatgtgtctagctccgtcattaccagcctcggagccatcgtgtcttgttacggcaagacaaaatgcacggcttccaataagaacaaggggattatcaaaaccttcagcaatggatgtgactatgtttctaacaagggcgtggacacagtctccgtgggcaataccctgtactatgttaacaaacaggaggggcagagcctttacgtgaagggagagcccattatcaacttttatgatcctctggtcttcccctccgacgaatttgatgcctctatcagccaagtgaatgagaaaattaaccagtccctcgctttcatccggaagtctgacgaactgctgcacaatgtgaacgccggcaagagcacaaccaatattatgatcacgaccattatcattgttatcatcgtcattctcctgtcccttatcgccgtggggctgctcctgtactgcaaagctcgcagcacaccggtgaccctgtctaaggatcagctttccggaattaacaatatcgcgttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6231 - RNA, 2057 nt, synthetic construct
  misc_feature 1..2057: note = mRNA product Design d-5 comprising derived and/or modified sequence from HRSV(A2)__F_DSCav1_mut6 (opt6)
  source 1..2057: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactattaatcttaaaagcaaatgctataaccacaatattaacagcagtaacattctgttttgcctccggacaaaacataacagaagaattttatcaatcaacatgctctgcagtatccaaaggttacttaggcgcactacgcactggatggtatacatcagtaataacaatagaactatcaaacataaaagaaaataaatgtaacggtactgacgcaaaagtgaaactaattaaacaagaactcgacaaatacaaaaatgctgtaacagacctacaaatgctaatgtgctcaacacccgcaaccggatcaggatcagccatagcctccggagtcgcagtatgcaaagtattacatcttgaaggagaagtaaataaaataaaatcagcattactatccacaaataaagccgtagtatcactatcaaacggtgtatccgtccttacattcaaagtattagatctaaaaaactacatagataaacaactactacccatcttaaacaaacaatcatgctcaattcccaacccagaaacagtcatggaatttcaacaaaaaaacaacagactcttagaaataacacgagaattttcagtaaacgcaggagtaaccacaccagtaagtacatacatgctcaccaactcagaattattatcacttattaacgacatgccaattacaaacgaccaaaaaaaattaatgtcaaacaatgtccaaattgttagacaacaatcatactctataatgtgtataataaaagaagaagtactagcttacgtagttcaattaccactatatggcgtaatagatacaccttgctggaaactacatacatctccattatgtacaactaacacaaaagaaggatctaacatatgcctaacacgcacagatcgaggatggtactgcgataatgcaggttccgtatcattctttccacaagcagaaacatgtaaagtatgctcaaacagagtattctgtgacactatgaactccttaaccctaccctcagaagtcaatctatgcaacgttgacatatttaacccaaaatacgactgtaaaatcatgacatctaaaacagacgtatcatcatcagttattacatccctaggagcaatagtatcttgctacggaaaaacaaaatgtacagcatccaacaaaaacaaaggaataatcaaaacattctcaaacggctgcgactacgtatcaaacaaaggtgtagacacagtatcagtaggaaatactttatattacgtaaataaacaagaaggacaatctctatacgttaaaggcgaacctattataaacttctacgacccactcgtattcccttcagacgaatttgacgcatctatatcccaagttaacgaaaaaatcaaccaatcattagcctttataagaaaatccgacgaattattacataacgtcaacgctggaaaatcaacaactaacataatgataaccacaataataatagtcatcatagttatattactaagtctaatagccgtaggcctcctactttattgcaaagcaagatcaacaccagtaacattatccaaagaccaactcagcggcataaacaatatagctttttcaaactagggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6232 - RNA, 2057 nt, synthetic construct
  misc_feature 1..2057: note = mRNA product Design d-5 comprising derived and/or modified sequence from HRSV(A2)__F_DSCav1_mut6 (opt11)
  source 1..2057: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcctcatcctcaaagccaacgcaatcacaaccatactaactgcagttactttctgcttcgcatccggccaaaacatcaccgaagagttctaccaatcaacctgctccgcagtctccaaaggatacctcggagcccttcgcaccggctggtacacctccgtcataaccatcgaactctcaaacataaaagaaaacaaatgcaacggcacagacgcgaaagtcaaacttatcaaacaagaactcgacaaatacaaaaacgccgtcaccgacctgcagatgctcatgtgctcaacccccgccacaggaagcggctctgctatcgcttccggcgtcgccgtctgcaaagtcctccacctcgaaggcgaagtaaacaaaatcaagtcagccctcctctccaccaacaaagccgtcgtctctctctcaaacggcgtatccgtcctcacattcaaagtcctcgacctcaaaaactacatcgacaaacaacttctccccatcctaaacaaacaatcatgctccatccccaaccccgaaacagtcatggaatttcaacaaaagaacaaccgcctcttagaaatcacccgagaattttccgtcaacgcgggagtcacaacccccgtttctacgtatatgctcaccaactccgaactcctttccctcataaacgacatgccaatcaccaacgaccaaaagaaactcatgtcaaacaacgtccaaatcgtccgacaacaatcctactctattatgtgcatcatcaaagaagaagttctcgcctacgtcgtccaactacccctctacggcgtgatcgacaccccctgctggaaactacacacctcacccctctgcaccaccaacaccaaggaaggctccaacatctgcctcacccgcaccgaccgcggctggtactgcgacaacgctggctccgtctcattcttcccgcaagccgaaacttgcaaagtatgctccaacagagtattctgcgacaccatgaactcactaaccctcccttccgaagtcaacctttgcaacgttgacatattcaacccaaagtacgattgcaaaattatgacatccaaaacagatgtctcctcctccgtcatcacatccctcggtgccattgtatcatgctacggaaaaaccaaatgcaccgcatccaacaaaaacaaaggaatcatcaaaaccttctcaaacggctgcgattacgtctcaaacaaaggagtcgacacagtctccgtcggaaacaccctatactacgtcaacaaacaagaaggccaatccctgtacgtcaaaggagaacccatcatcaacttctacgaccccctcgtcttcccgagcgacgagttcgacgcctccatctcacaagtcaatgaaaagatcaaccaatcccttgccttcatccggaaatcggacgaactcctacacaacgtgaacgctggaaaatcaaccaccaacatcatgatcacaaccatcattatcgtcatcatcgtcatactcctctccctaatcgccgtcggcctcctcctgtattgcaaagctcgctccacccccgtcaccctgtccaaagaccaactctccggaatcaacaacatcgccttctcaaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6233 - RNA, 1937 nt, synthetic construct
  misc_feature 1..1937: note = mRNA product Design e-1 comprising derived and/or modified sequence from HRSV(A2)__F_DSCav1_mut6 (opt1)
  source 1..1937: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaaccccgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6234 - RNA, 1937 nt, synthetic construct
  misc_feature 1..1937: note = mRNA product Design e-1 comprising derived and/or modified sequence from HRSV(A2)__F_DSCav1_mut6 (opt1)
  source 1..1937: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctcatgtgcagcacccccgccaccgggtccggcagcgccatcgcctccggcgtggcggtgtgcaaggtcctgcacctggagggggaggtgaacaagatcaagagcgccctcctgtccaccaacaaggccgtggtcagcctgtccaacggcgtgagcgtgctcacgttcaaggtcctggacctgaagaactacatcgacaagcagctcctgccgatcctgaacaagcagtcctgcagcatccccaaccccgagaccgtgatggagttccagcagaagaacaaccggctcctggagatcacccgcgagttctccgtgaacgccggggtcaccacgcccgtgagcacctacatgctgaccaactccgagctcctgagcctgatcaacgacatgccgatcaccaacgaccagaagaagctcatgagcaacaacgtgcagatcgtccggcagcagtcctacagcatcatgtgcatcatcaaggaggaggtgctggcctacgtggtccagctgcccctctacggcgtgatcgacacgccctgctggaagctgcacaccagccccctgtgcaccaccaacacgaaggaggggagcaacatctgcctcacccgcaccgaccggggctggtactgcgacaacgcgggctccgtgagcttcttcccgcaggccgagacctgcaaggtctgctccaaccgcgtgttctgcgacacgatgaacagcctgaccctgccctccgaggtcaacctctgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaacaaggggatcatcaagaccttctccaacggctgcgactacgtgagcaacaagggcgtcgacacggtgtccgtggggaacaccctgtactacgtcaacaagcaggagggccagagcctctacgtgaagggggagcccatcatcaacttctacgacccgctggtgttccccagcgacgagttcgacgcctccatcagccaggtcaacgagaagatcaaccagtccctggcgttcatccggaagtccgacgagctcctgcacaacgtgaacgccggcaagtccaccaccaacatcatgatcaccacgatcatcatcgtgatcatcgtcatcctgctcagcctgatcgccgtggggctgctcctgtactgcaaggcccgctccacccccgtgaccctgagcaaggaccagctgtccggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6235 - RNA, 1937 nt, synthetic construct
  misc_feature 1..1937: note = mRNA product Design e-1 comprising derived and/or modified sequence from HRSV(A2)__F_DSCav1_mut6 (opt2)
  source 1..1937: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6236 - RNA, 1937 nt, synthetic construct
  misc_feature 1..1937: note = mRNA product Design e-1 comprising derived and/or modified sequence from HRSV(A2)__F_DSCav1_mut6 (opt3)
  source 1..1937: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagatgcttatgtgttccacacccgccaccgggtctggatcggctatagcatcaggcgtggccgtctgcaaggtgctgcacttggagggtgaggttaacaaaatcaagagcgctctcctgagtacgaataaagccgtggtctccctgtctaacggggtgagcgtactcacttttaaggttttagatctgaagaattacattgacaaacagcttttgcctatcctgaacaagcaatcctgttcaattccaaatccggaaaccgtgatggagttccagcagaaaaacaataggctactcgaaatcacacgggagtttagtgtcaacgcgggagtgactacccccgtgagcacatatatgctgaccaattctgagcttctgtccttgataaacgatatgcctattacgaacgaccagaagaaactcatgtcaaataacgtccaaatcgttcgccagcagagctacagtattatgtgcatcatcaaggaagaggtgctggcatatgtagtgcagttaccactgtacggcgtcattgatactccctgttggaaactccatacatctcctctttgcaccactaatacaaaggaaggctccaacatatgtctgacccgaacggaccgtgggtggtactgcgataatgccggaagcgtgtcgttctttccacaagctgagacctgtaaggtttgctctaacagagtgttctgcgacacaatgaactccttgactctaccctcagaagtcaatctgtgtaatgtggatatctttaaccctaaatatgactgcaagattatgaccagtaaaacagatgtaagctcctctgttatcactagcctcggtgccatagtgtcatgttacggcaagaccaaatgcacagcaagtaataagaacaaggggattatcaaaaccttctccaatggatgtgactatgtcagcaacaagggcgtggacactgtctctgtgggtaatacgctgtactatgttaacaaacaggaggggcagtcactttacgtgaagggagagccaatcattaacttttatgatccgctggtattccccagtgacgaatttgatgctagcatctcccaagtcaatgagaaaattaaccagtctttggccttcataaggaagtcggacgaactcctgcacaatgtgaacgcgggcaagagcacaaccaatatcatgattactaccatcatcattgttataatcgtgattttactgtccctaatcgccgtcggcctcctgctttactgcaaagcacggtcaacacctgtgaccttgagtaaggatcagctgtctgggattaacaatatcgctttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6237 - RNA, 1937 nt, synthetic construct
  misc_feature 1..1937: note = mRNA product Design e-1 comprising derived and/or modified sequence from HRSV(A2)__F_DSCav1_mut6 (opt4)
  source 1..1937: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6238 - RNA, 1937 nt, synthetic construct
  misc_feature 1..1937: note = mRNA product Design e-1 comprising derived and/or modified sequence from HRSV(A2)__F_DSCav1_mut6 (opt5)
  source 1..1937: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagatgctgatgtgtagcacccccgccacaggatccggctctgctattgccagcggggtcgcggtgtgcaaggttctgcacctcgagggagaggtgaacaaaatcaagtccgccctgcttagcaccaataaagctgtcgtgtctctgtccaacggcgttagcgtgctcacatttaaggtcctggatcttaagaattacattgacaaacagctgctccctatcctgaacaagcaatcttgttccattccgaatcccgaaaccgtgatggagttccagcagaaaaacaatcggctgctcgaaatcacgcgcgagtttagcgtgaacgccggcgtcacaacccctgtttctacatatatgctgaccaattccgagcttctgagcctcattaacgatatgcccatcaccaacgaccagaagaaactgatgtccaataacgtgcaaatcgtgagacagcagtcttacagcattatgtgcatcattaaggaagaggtccttgcttatgtggttcagctgcctctctacggggtgatcgatacaccctgttggaaactgcatacgtcccctctgtgcaccacaaataccaaggaaggaagcaacatttgtctcacacggaccgaccgcggctggtactgcgataatgccgggtctgtctccttctttccgcaagcggagacgtgtaaggtgtgcagcaacagagttttctgcgacacaatgaactctctgacccttcccagcgaagtgaatctgtgtaatgtcgatatctttaaccctaaatatgactgcaagatcatgacctccaaaacagatgtgtctagctccgtcattaccagcctcggagccatcgtgtcttgttacggcaagacaaaatgcacggcttccaataagaacaaggggattatcaaaaccttcagcaatggatgtgactatgtttctaacaagggcgtggacacagtctccgtgggcaataccctgtactatgttaacaaacaggaggggcagagcctttacgtgaagggagagcccattatcaacttttatgatcctctggtcttcccctccgacgaatttgatgcctctatcagccaagtgaatgagaaaattaaccagtccctcgctttcatccggaagtctgacgaactgctgcacaatgtgaacgccggcaagagcacaaccaatattatgatcacgaccattatcattgttatcatcgtcattctcctgtcccttatcgccgtggggctgctcctgtactgcaaagctcgcagcacaccggtgaccctgtctaaggatcagctttccggaattaacaatatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6239 - RNA, 1937 nt, synthetic construct
  misc_feature 1..1937: note = mRNA product Design e-1 comprising derived and/or modified sequence from HRSV(A2)__F_DSCav1_mut6 (opt6)
  source 1..1937: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggaactattaatcttaaaagcaaatgctataaccacaatattaacagcagtaacattctgttttgcctccggacaaaacataacagaagaattttatcaatcaacatgctctgcagtatccaaaggttacttaggcgcactacgcactggatggtatacatcagtaataacaatagaactatcaaacataaaagaaaataaatgtaacggtactgacgcaaaagtgaaactaattaaacaagaactcgacaaatacaaaaatgctgtaacagacctacaaatgctaatgtgctcaacacccgcaaccggatcaggatcagccatagcctccggagtcgcagtatgcaaagtattacatcttgaaggagaagtaaataaaataaaatcagcattactatccacaaataaagccgtagtatcactatcaaacggtgtatccgtccttacattcaaagtattagatctaaaaaactacatagataaacaactactacccatcttaaacaaacaatcatgctcaattcccaacccagaaacagtcatggaatttcaacaaaaaaacaacagactcttagaaataacacgagaattttcagtaaacgcaggagtaaccacaccagtaagtacatacatgctcaccaactcagaattattatcacttattaacgacatgccaattacaaacgaccaaaaaaaattaatgtcaaacaatgtccaaattgttagacaacaatcatactctataatgtgtataataaaagaagaagtactagcttacgtagttcaattaccactatatggcgtaatagatacaccttgctggaaactacatacatctccattatgtacaactaacacaaaagaaggatctaacatatgcctaacacgcacagatcgaggatggtactgcgataatgcaggttccgtatcattctttccacaagcagaaacatgtaaagtatgctcaaacagagtattctgtgacactatgaactccttaaccctaccctcagaagtcaatctatgcaacgttgacatatttaacccaaaatacgactgtaaaatcatgacatctaaaacagacgtatcatcatcagttattacatccctaggagcaatagtatcttgctacggaaaaacaaaatgtacagcatccaacaaaaacaaaggaataatcaaaacattctcaaacggctgcgactacgtatcaaacaaaggtgtagacacagtatcagtaggaaatactttatattacgtaaataaacaagaaggacaatctctatacgttaaaggcgaacctattataaacttctacgacccactcgtattcccttcagacgaatttgacgcatctatatcccaagttaacgaaaaaatcaaccaatcattagcctttataagaaaatccgacgaattattacataacgtcaacgctggaaaatcaacaactaacataatgataaccacaataataatagtcatcatagttatattactaagtctaatagccgtaggcctcctactttattgcaaagcaagatcaacaccagtaacattatccaaagaccaactcagcggcataaacaatatagctttttcaaactagggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6240 - RNA, 1937 nt, synthetic construct
  misc_feature 1..1937: note = mRNA product Design e-1 comprising derived and/or modified sequence from HRSV(A2)__F_DSCav1_mut6 (opt11)
  source 1..1937: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggaactcctcatcctcaaagccaacgcaatcacaaccatactaactgcagttactttctgcttcgcatccggccaaaacatcaccgaagagttctaccaatcaacctgctccgcagtctccaaaggatacctcggagcccttcgcaccggctggtacacctccgtcataaccatcgaactctcaaacataaaagaaaacaaatgcaacggcacagacgcgaaagtcaaacttatcaaacaagaactcgacaaatacaaaaacgccgtcaccgacctgcagatgctcatgtgctcaacccccgccacaggaagcggctctgctatcgcttccggcgtcgccgtctgcaaagtcctccacctcgaaggcgaagtaaacaaaatcaagtcagccctcctctccaccaacaaagccgtcgtctctctctcaaacggcgtatccgtcctcacattcaaagtcctcgacctcaaaaactacatcgacaaacaacttctccccatcctaaacaaacaatcatgctccatccccaaccccgaaacagtcatggaatttcaacaaaagaacaaccgcctcttagaaatcacccgagaattttccgtcaacgcgggagtcacaacccccgtttctacgtatatgctcaccaactccgaactcctttccctcataaacgacatgccaatcaccaacgaccaaaagaaactcatgtcaaacaacgtccaaatcgtccgacaacaatcctactctattatgtgcatcatcaaagaagaagttctcgcctacgtcgtccaactacccctctacggcgtgatcgacaccccctgctggaaactacacacctcacccctctgcaccaccaacaccaaggaaggctccaacatctgcctcacccgcaccgaccgcggctggtactgcgacaacgctggctccgtctcattcttcccgcaagccgaaacttgcaaagtatgctccaacagagtattctgcgacaccatgaactcactaaccctcccttccgaagtcaacctttgcaacgttgacatattcaacccaaagtacgattgcaaaattatgacatccaaaacagatgtctcctcctccgtcatcacatccctcggtgccattgtatcatgctacggaaaaaccaaatgcaccgcatccaacaaaaacaaaggaatcatcaaaaccttctcaaacggctgcgattacgtctcaaacaaaggagtcgacacagtctccgtcggaaacaccctatactacgtcaacaaacaagaaggccaatccctgtacgtcaaaggagaacccatcatcaacttctacgaccccctcgtcttcccgagcgacgagttcgacgcctccatctcacaagtcaatgaaaagatcaaccaatcccttgccttcatccggaaatcggacgaactcctacacaacgtgaacgctggaaaatcaaccaccaacatcatgatcacaaccatcattatcgtcatcatcgtcatactcctctccctaatcgccgtcggcctcctcctgtattgcaaagctcgctccacccccgtcaccctgtccaaagaccaactctccggaatcaacaacatcgccttctcaaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6241 - RNA, 1919 nt, synthetic construct
  misc_feature 1..1919: note = mRNA product Design e-2 comprising derived and/or modified sequence from HRSV(A2)__F_DSCav1_mut6 (opt1)
  source 1..1919: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaaccccgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6242 - RNA, 1919 nt, synthetic construct
  misc_feature 1..1919: note = mRNA product Design e-2 comprising derived and/or modified sequence from HRSV(A2)__F_DSCav1_mut6 (opt1)
  source 1..1919: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctcatgtgcagcacccccgccaccgggtccggcagcgccatcgcctccggcgtggcggtgtgcaaggtcctgcacctggagggggaggtgaacaagatcaagagcgccctcctgtccaccaacaaggccgtggtcagcctgtccaacggcgtgagcgtgctcacgttcaaggtcctggacctgaagaactacatcgacaagcagctcctgccgatcctgaacaagcagtcctgcagcatccccaaccccgagaccgtgatggagttccagcagaagaacaaccggctcctggagatcacccgcgagttctccgtgaacgccggggtcaccacgcccgtgagcacctacatgctgaccaactccgagctcctgagcctgatcaacgacatgccgatcaccaacgaccagaagaagctcatgagcaacaacgtgcagatcgtccggcagcagtcctacagcatcatgtgcatcatcaaggaggaggtgctggcctacgtggtccagctgcccctctacggcgtgatcgacacgccctgctggaagctgcacaccagccccctgtgcaccaccaacacgaaggaggggagcaacatctgcctcacccgcaccgaccggggctggtactgcgacaacgcgggctccgtgagcttcttcccgcaggccgagacctgcaaggtctgctccaaccgcgtgttctgcgacacgatgaacagcctgaccctgccctccgaggtcaacctctgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaacaaggggatcatcaagaccttctccaacggctgcgactacgtgagcaacaagggcgtcgacacggtgtccgtggggaacaccctgtactacgtcaacaagcaggagggccagagcctctacgtgaagggggagcccatcatcaacttctacgacccgctggtgttccccagcgacgagttcgacgcctccatcagccaggtcaacgagaagatcaaccagtccctggcgttcatccggaagtccgacgagctcctgcacaacgtgaacgccggcaagtccaccaccaacatcatgatcaccacgatcatcatcgtgatcatcgtcatcctgctcagcctgatcgccgtggggctgctcctgtactgcaaggcccgctccacccccgtgaccctgagcaaggaccagctgtccggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6243 - RNA, 1919 nt, synthetic construct
  misc_feature 1..1919: note = mRNA product Design e-2 comprising derived and/or modified sequence from HRSV(A2)__F_DSCav1_mut6 (opt2)
  source 1..1919: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6244 - RNA, 1919 nt, synthetic construct
  misc_feature 1..1919: note = mRNA product Design e-2 comprising derived and/or modified sequence from HRSV(A2)__F_DSCav1_mut6 (opt3)
  source 1..1919: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagatgcttatgtgttccacacccgccaccgggtctggatcggctatagcatcaggcgtggccgtctgcaaggtgctgcacttggagggtgaggttaacaaaatcaagagcgctctcctgagtacgaataaagccgtggtctccctgtctaacggggtgagcgtactcacttttaaggttttagatctgaagaattacattgacaaacagcttttgcctatcctgaacaagcaatcctgttcaattccaaatccggaaaccgtgatggagttccagcagaaaaacaataggctactcgaaatcacacgggagtttagtgtcaacgcgggagtgactacccccgtgagcacatatatgctgaccaattctgagcttctgtccttgataaacgatatgcctattacgaacgaccagaagaaactcatgtcaaataacgtccaaatcgttcgccagcagagctacagtattatgtgcatcatcaaggaagaggtgctggcatatgtagtgcagttaccactgtacggcgtcattgatactccctgttggaaactccatacatctcctctttgcaccactaatacaaaggaaggctccaacatatgtctgacccgaacggaccgtgggtggtactgcgataatgccggaagcgtgtcgttctttccacaagctgagacctgtaaggtttgctctaacagagtgttctgcgacacaatgaactccttgactctaccctcagaagtcaatctgtgtaatgtggatatctttaaccctaaatatgactgcaagattatgaccagtaaaacagatgtaagctcctctgttatcactagcctcggtgccatagtgtcatgttacggcaagaccaaatgcacagcaagtaataagaacaaggggattatcaaaaccttctccaatggatgtgactatgtcagcaacaagggcgtggacactgtctctgtgggtaatacgctgtactatgttaacaaacaggaggggcagtcactttacgtgaagggagagccaatcattaacttttatgatccgctggtattccccagtgacgaatttgatgctagcatctcccaagtcaatgagaaaattaaccagtctttggccttcataaggaagtcggacgaactcctgcacaatgtgaacgcgggcaagagcacaaccaatatcatgattactaccatcatcattgttataatcgtgattttactgtccctaatcgccgtcggcctcctgctttactgcaaagcacggtcaacacctgtgaccttgagtaaggatcagctgtctgggattaacaatatcgctttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6245 - RNA, 1919 nt, synthetic construct
  misc_feature 1..1919: note = mRNA product Design e-2 comprising derived and/or modified sequence from HRSV(A2)__F_DSCav1_mut6 (opt4)
  source 1..1919: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6246 - RNA, 1919 nt, synthetic construct
  misc_feature 1..1919: note = mRNA product Design e-2 comprising derived and/or modified sequence from HRSV(A2)__F_DSCav1_mut6 (opt5)
  source 1..1919: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagatgctgatgtgtagcacccccgccacaggatccggctctgctattgccagcggggtcgcggtgtgcaaggttctgcacctcgagggagaggtgaacaaaatcaagtccgccctgcttagcaccaataaagctgtcgtgtctctgtccaacggcgttagcgtgctcacatttaaggtcctggatcttaagaattacattgacaaacagctgctccctatcctgaacaagcaatcttgttccattccgaatcccgaaaccgtgatggagttccagcagaaaaacaatcggctgctcgaaatcacgcgcgagtttagcgtgaacgccggcgtcacaacccctgtttctacatatatgctgaccaattccgagcttctgagcctcattaacgatatgcccatcaccaacgaccagaagaaactgatgtccaataacgtgcaaatcgtgagacagcagtcttacagcattatgtgcatcattaaggaagaggtccttgcttatgtggttcagctgcctctctacggggtgatcgatacaccctgttggaaactgcatacgtcccctctgtgcaccacaaataccaaggaaggaagcaacatttgtctcacacggaccgaccgcggctggtactgcgataatgccgggtctgtctccttctttccgcaagcggagacgtgtaaggtgtgcagcaacagagttttctgcgacacaatgaactctctgacccttcccagcgaagtgaatctgtgtaatgtcgatatctttaaccctaaatatgactgcaagatcatgacctccaaaacagatgtgtctagctccgtcattaccagcctcggagccatcgtgtcttgttacggcaagacaaaatgcacggcttccaataagaacaaggggattatcaaaaccttcagcaatggatgtgactatgtttctaacaagggcgtggacacagtctccgtgggcaataccctgtactatgttaacaaacaggaggggcagagcctttacgtgaagggagagcccattatcaacttttatgatcctctggtcttcccctccgacgaatttgatgcctctatcagccaagtgaatgagaaaattaaccagtccctcgctttcatccggaagtctgacgaactgctgcacaatgtgaacgccggcaagagcacaaccaatattatgatcacgaccattatcattgttatcatcgtcattctcctgtcccttatcgccgtggggctgctcctgtactgcaaagctcgcagcacaccggtgaccctgtctaaggatcagctttccggaattaacaatatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6247 - RNA, 1919 nt, synthetic construct
  misc_feature 1..1919: note = mRNA product Design e-2 comprising derived and/or modified sequence from HRSV(A2)__F_DSCav1_mut6 (opt6)
  source 1..1919: mol_type = other RNA
gggagacccgtgacccggaagttgtacggctacgcgactttccctcccacaaaccctcgcgcccttcctttcctacttgggcccggcagaaagcttaccatggaactattaatcttaaaagcaaatgctataaccacaatattaacagcagtaacattctgttttgcctccggacaaaacataacagaagaattttatcaatcaacatgctctgcagtatccaaaggttacttaggcgcactacgcactggatggtatacatcagtaataacaatagaactatcaaacataaaagaaaataaatgtaacggtactgacgcaaaagtgaaactaattaaacaagaactcgacaaatacaaaaatgctgtaacagacctacaaatgctaatgtgctcaacacccgcaaccggatcaggatcagccatagcctccggagtcgcagtatgcaaagtattacatcttgaaggagaagtaaataaaataaaatcagcattactatccacaaataaagccgtagtatcactatcaaacggtgtatccgtccttacattcaaagtattagatctaaaaaactacatagataaacaactactacccatcttaaacaaacaatcatgctcaattcccaacccagaaacagtcatggaatttcaacaaaaaaacaacagactcttagaaataacacgagaattttcagtaaacgcaggagtaaccacaccagtaagtacatacatgctcaccaactcagaattattatcacttattaacgacatgccaattacaaacgaccaaaaaaaattaatgtcaaacaatgtccaaattgttagacaacaatcatactctataatgtgtataataaaagaagaagtactagcttacgtagttcaattaccactatatggcgtaatagatacaccttgctggaaactacatacatctccattatgtacaactaacacaaaagaaggatctaacatatgcctaacacgcacagatcgaggatggtactgcgataatgcaggttccgtatcattctttccacaagcagaaacatgtaaagtatgctcaaacagagtattctgtgacactatgaactccttaaccctaccctcagaagtcaatctatgcaacgttgacatatttaacccaaaatacgactgtaaaatcatgacatctaaaacagacgtatcatcatcagttattacatccctaggagcaatagtatcttgctacggaaaaacaaaatgtacagcatccaacaaaaacaaaggaataatcaaaacattctcaaacggctgcgactacgtatcaaacaaaggtgtagacacagtatcagtaggaaatactttatattacgtaaataaacaagaaggacaatctctatacgttaaaggcgaacctattataaacttctacgacccactcgtattcccttcagacgaatttgacgcatctatatcccaagttaacgaaaaaatcaaccaatcattagcctttataagaaaatccgacgaattattacataacgtcaacgctggaaaatcaacaactaacataatgataaccacaataataatagtcatcatagttatattactaagtctaatagccgtaggcctcctactttattgcaaagcaagatcaacaccagtaacattatccaaagaccaactcagcggcataaacaatatagctttttcaaactagggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6248 - RNA, 1919 nt, synthetic construct
  misc_feature 1..1919: note = mRNA product Design e-2 comprising derived and/or modified sequence from HRSV(A2)__F_DSCav1_mut6 (opt11)
  source 1..1919: mol_type = other RNA
gggagacccgtgacccggaagttgtacggctacgcgactttccctcccacaaaccctcgcgcccttcctttcctacttgggcccggcagaaagcttaccatggaactcctcatcctcaaagccaacgcaatcacaaccatactaactgcagttactttctgcttcgcatccggccaaaacatcaccgaagagttctaccaatcaacctgctccgcagtctccaaaggatacctcggagcccttcgcaccggctggtacacctccgtcataaccatcgaactctcaaacataaaagaaaacaaatgcaacggcacagacgcgaaagtcaaacttatcaaacaagaactcgacaaatacaaaaacgccgtcaccgacctgcagatgctcatgtgctcaacccccgccacaggaagcggctctgctatcgcttccggcgtcgccgtctgcaaagtcctccacctcgaaggcgaagtaaacaaaatcaagtcagccctcctctccaccaacaaagccgtcgtctctctctcaaacggcgtatccgtcctcacattcaaagtcctcgacctcaaaaactacatcgacaaacaacttctccccatcctaaacaaacaatcatgctccatccccaaccccgaaacagtcatggaatttcaacaaaagaacaaccgcctcttagaaatcacccgagaattttccgtcaacgcgggagtcacaacccccgtttctacgtatatgctcaccaactccgaactcctttccctcataaacgacatgccaatcaccaacgaccaaaagaaactcatgtcaaacaacgtccaaatcgtccgacaacaatcctactctattatgtgcatcatcaaagaagaagttctcgcctacgtcgtccaactacccctctacggcgtgatcgacaccccctgctggaaactacacacctcacccctctgcaccaccaacaccaaggaaggctccaacatctgcctcacccgcaccgaccgcggctggtactgcgacaacgctggctccgtctcattcttcccgcaagccgaaacttgcaaagtatgctccaacagagtattctgcgacaccatgaactcactaaccctcccttccgaagtcaacctttgcaacgttgacatattcaacccaaagtacgattgcaaaattatgacatccaaaacagatgtctcctcctccgtcatcacatccctcggtgccattgtatcatgctacggaaaaaccaaatgcaccgcatccaacaaaaacaaaggaatcatcaaaaccttctcaaacggctgcgattacgtctcaaacaaaggagtcgacacagtctccgtcggaaacaccctatactacgtcaacaaacaagaaggccaatccctgtacgtcaaaggagaacccatcatcaacttctacgaccccctcgtcttcccgagcgacgagttcgacgcctccatctcacaagtcaatgaaaagatcaaccaatcccttgccttcatccggaaatcggacgaactcctacacaacgtgaacgctggaaaatcaaccaccaacatcatgatcacaaccatcattatcgtcatcatcgtcatactcctctccctaatcgccgtcggcctcctcctgtattgcaaagctcgctccacccccgtcaccctgtccaaagaccaactctccggaatcaacaacatcgccttctcaaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6249 - RNA, 1889 nt, synthetic construct
  misc_feature 1..1889: note = mRNA product Design e-3 comprising derived and/or modified sequence from HRSV(A2)__F_DSCav1_mut6 (opt1)
  source 1..1889: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaaccccgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6250 - RNA, 1889 nt, synthetic construct
  misc_feature 1..1889: note = mRNA product Design e-3 comprising derived and/or modified sequence from HRSV(A2)__F_DSCav1_mut6 (opt1)
  source 1..1889: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctcatgtgcagcacccccgccaccgggtccggcagcgccatcgcctccggcgtggcggtgtgcaaggtcctgcacctggagggggaggtgaacaagatcaagagcgccctcctgtccaccaacaaggccgtggtcagcctgtccaacggcgtgagcgtgctcacgttcaaggtcctggacctgaagaactacatcgacaagcagctcctgccgatcctgaacaagcagtcctgcagcatccccaaccccgagaccgtgatggagttccagcagaagaacaaccggctcctggagatcacccgcgagttctccgtgaacgccggggtcaccacgcccgtgagcacctacatgctgaccaactccgagctcctgagcctgatcaacgacatgccgatcaccaacgaccagaagaagctcatgagcaacaacgtgcagatcgtccggcagcagtcctacagcatcatgtgcatcatcaaggaggaggtgctggcctacgtggtccagctgcccctctacggcgtgatcgacacgccctgctggaagctgcacaccagccccctgtgcaccaccaacacgaaggaggggagcaacatctgcctcacccgcaccgaccggggctggtactgcgacaacgcgggctccgtgagcttcttcccgcaggccgagacctgcaaggtctgctccaaccgcgtgttctgcgacacgatgaacagcctgaccctgccctccgaggtcaacctctgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaacaaggggatcatcaagaccttctccaacggctgcgactacgtgagcaacaagggcgtcgacacggtgtccgtggggaacaccctgtactacgtcaacaagcaggagggccagagcctctacgtgaagggggagcccatcatcaacttctacgacccgctggtgttccccagcgacgagttcgacgcctccatcagccaggtcaacgagaagatcaaccagtccctggcgttcatccggaagtccgacgagctcctgcacaacgtgaacgccggcaagtccaccaccaacatcatgatcaccacgatcatcatcgtgatcatcgtcatcctgctcagcctgatcgccgtggggctgctcctgtactgcaaggcccgctccacccccgtgaccctgagcaaggaccagctgtccggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6251 - RNA, 1889 nt, synthetic construct
  misc_feature 1..1889: note = mRNA product Design e-3 comprising derived and/or modified sequence from HRSV(A2)__F_DSCav1_mut6 (opt2)
  source 1..1889: mol_type = other RNA
gggagactttcccattctgtagcagaatttggtgttgcctgtggtcttggtcccgcggagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6252 - RNA, 1889 nt, synthetic construct
  misc_feature 1..1889: note = mRNA product Design e-3 comprising derived and/or modified sequence from HRSV(A2)__F_DSCav1_mut6 (opt3)
  source 1..1889: mol_type = other RNA
gggagactttcccattctgtagcagaatttggtgttgcctgtggtcttggtcccgcggagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagatgcttatgtgttccacacccgccaccgggtctggatcggctatagcatcaggcgtggccgtctgcaaggtgctgcacttggagggtgaggttaacaaaatcaagagcgctctcctgagtacgaataaagccgtggtctccctgtctaacggggtgagcgtactcacttttaaggttttagatctgaagaattacattgacaaacagcttttgcctatcctgaacaagcaatcctgttcaattccaaatccggaaaccgtgatggagttccagcagaaaaacaataggctactcgaaatcacacgggagtttagtgtcaacgcgggagtgactacccccgtgagcacatatatgctgaccaattctgagcttctgtccttgataaacgatatgcctattacgaacgaccagaagaaactcatgtcaaataacgtccaaatcgttcgccagcagagctacagtattatgtgcatcatcaaggaagaggtgctggcatatgtagtgcagttaccactgtacggcgtcattgatactccctgttggaaactccatacatctcctctttgcaccactaatacaaaggaaggctccaacatatgtctgacccgaacggaccgtgggtggtactgcgataatgccggaagcgtgtcgttctttccacaagctgagacctgtaaggtttgctctaacagagtgttctgcgacacaatgaactccttgactctaccctcagaagtcaatctgtgtaatgtggatatctttaaccctaaatatgactgcaagattatgaccagtaaaacagatgtaagctcctctgttatcactagcctcggtgccatagtgtcatgttacggcaagaccaaatgcacagcaagtaataagaacaaggggattatcaaaaccttctccaatggatgtgactatgtcagcaacaagggcgtggacactgtctctgtgggtaatacgctgtactatgttaacaaacaggaggggcagtcactttacgtgaagggagagccaatcattaacttttatgatccgctggtattccccagtgacgaatttgatgctagcatctcccaagtcaatgagaaaattaaccagtctttggccttcataaggaagtcggacgaactcctgcacaatgtgaacgcgggcaagagcacaaccaatatcatgattactaccatcatcattgttataatcgtgattttactgtccctaatcgccgtcggcctcctgctttactgcaaagcacggtcaacacctgtgaccttgagtaaggatcagctgtctgggattaacaatatcgctttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6253 - RNA, 1889 nt, synthetic construct
  misc_feature 1..1889: note = mRNA product Design e-3 comprising derived and/or modified sequence from HRSV(A2)__F_DSCav1_mut6 (opt4)
  source 1..1889: mol_type = other RNA
gggagactttcccattctgtagcagaatttggtgttgcctgtggtcttggtcccgcggagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6254 - RNA, 1889 nt, synthetic construct
  misc_feature 1..1889: note = mRNA product Design e-3 comprising derived and/or modified sequence from HRSV(A2)__F_DSCav1_mut6 (opt5)
  source 1..1889: mol_type = other RNA
gggagactttcccattctgtagcagaatttggtgttgcctgtggtcttggtcccgcggagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagatgctgatgtgtagcacccccgccacaggatccggctctgctattgccagcggggtcgcggtgtgcaaggttctgcacctcgagggagaggtgaacaaaatcaagtccgccctgcttagcaccaataaagctgtcgtgtctctgtccaacggcgttagcgtgctcacatttaaggtcctggatcttaagaattacattgacaaacagctgctccctatcctgaacaagcaatcttgttccattccgaatcccgaaaccgtgatggagttccagcagaaaaacaatcggctgctcgaaatcacgcgcgagtttagcgtgaacgccggcgtcacaacccctgtttctacatatatgctgaccaattccgagcttctgagcctcattaacgatatgcccatcaccaacgaccagaagaaactgatgtccaataacgtgcaaatcgtgagacagcagtcttacagcattatgtgcatcattaaggaagaggtccttgcttatgtggttcagctgcctctctacggggtgatcgatacaccctgttggaaactgcatacgtcccctctgtgcaccacaaataccaaggaaggaagcaacatttgtctcacacggaccgaccgcggctggtactgcgataatgccgggtctgtctccttctttccgcaagcggagacgtgtaaggtgtgcagcaacagagttttctgcgacacaatgaactctctgacccttcccagcgaagtgaatctgtgtaatgtcgatatctttaaccctaaatatgactgcaagatcatgacctccaaaacagatgtgtctagctccgtcattaccagcctcggagccatcgtgtcttgttacggcaagacaaaatgcacggcttccaataagaacaaggggattatcaaaaccttcagcaatggatgtgactatgtttctaacaagggcgtggacacagtctccgtgggcaataccctgtactatgttaacaaacaggaggggcagagcctttacgtgaagggagagcccattatcaacttttatgatcctctggtcttcccctccgacgaatttgatgcctctatcagccaagtgaatgagaaaattaaccagtccctcgctttcatccggaagtctgacgaactgctgcacaatgtgaacgccggcaagagcacaaccaatattatgatcacgaccattatcattgttatcatcgtcattctcctgtcccttatcgccgtggggctgctcctgtactgcaaagctcgcagcacaccggtgaccctgtctaaggatcagctttccggaattaacaatatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6255 - RNA, 1889 nt, synthetic construct
  misc_feature 1..1889: note = mRNA product Design e-3 comprising derived and/or modified sequence from HRSV(A2)__F_DSCav1_mut6 (opt6)
  source 1..1889: mol_type = other RNA
gggagactttcccattctgtagcagaatttggtgttgcctgtggtcttggtcccgcggagaagcttaccatggaactattaatcttaaaagcaaatgctataaccacaatattaacagcagtaacattctgttttgcctccggacaaaacataacagaagaattttatcaatcaacatgctctgcagtatccaaaggttacttaggcgcactacgcactggatggtatacatcagtaataacaatagaactatcaaacataaaagaaaataaatgtaacggtactgacgcaaaagtgaaactaattaaacaagaactcgacaaatacaaaaatgctgtaacagacctacaaatgctaatgtgctcaacacccgcaaccggatcaggatcagccatagcctccggagtcgcagtatgcaaagtattacatcttgaaggagaagtaaataaaataaaatcagcattactatccacaaataaagccgtagtatcactatcaaacggtgtatccgtccttacattcaaagtattagatctaaaaaactacatagataaacaactactacccatcttaaacaaacaatcatgctcaattcccaacccagaaacagtcatggaatttcaacaaaaaaacaacagactcttagaaataacacgagaattttcagtaaacgcaggagtaaccacaccagtaagtacatacatgctcaccaactcagaattattatcacttattaacgacatgccaattacaaacgaccaaaaaaaattaatgtcaaacaatgtccaaattgttagacaacaatcatactctataatgtgtataataaaagaagaagtactagcttacgtagttcaattaccactatatggcgtaatagatacaccttgctggaaactacatacatctccattatgtacaactaacacaaaagaaggatctaacatatgcctaacacgcacagatcgaggatggtactgcgataatgcaggttccgtatcattctttccacaagcagaaacatgtaaagtatgctcaaacagagtattctgtgacactatgaactccttaaccctaccctcagaagtcaatctatgcaacgttgacatatttaacccaaaatacgactgtaaaatcatgacatctaaaacagacgtatcatcatcagttattacatccctaggagcaatagtatcttgctacggaaaaacaaaatgtacagcatccaacaaaaacaaaggaataatcaaaacattctcaaacggctgcgactacgtatcaaacaaaggtgtagacacagtatcagtaggaaatactttatattacgtaaataaacaagaaggacaatctctatacgttaaaggcgaacctattataaacttctacgacccactcgtattcccttcagacgaatttgacgcatctatatcccaagttaacgaaaaaatcaaccaatcattagcctttataagaaaatccgacgaattattacataacgtcaacgctggaaaatcaacaactaacataatgataaccacaataataatagtcatcatagttatattactaagtctaatagccgtaggcctcctactttattgcaaagcaagatcaacaccagtaacattatccaaagaccaactcagcggcataaacaatatagctttttcaaactagggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6256 - RNA, 1889 nt, synthetic construct
  misc_feature 1..1889: note = mRNA product Design e-3 comprising derived and/or modified sequence from HRSV(A2)__F_DSCav1_mut6 (opt11)
  source 1..1889: mol_type = other RNA
gggagactttcccattctgtagcagaatttggtgttgcctgtggtcttggtcccgcggagaagcttaccatggaactcctcatcctcaaagccaacgcaatcacaaccatactaactgcagttactttctgcttcgcatccggccaaaacatcaccgaagagttctaccaatcaacctgctccgcagtctccaaaggatacctcggagcccttcgcaccggctggtacacctccgtcataaccatcgaactctcaaacataaaagaaaacaaatgcaacggcacagacgcgaaagtcaaacttatcaaacaagaactcgacaaatacaaaaacgccgtcaccgacctgcagatgctcatgtgctcaacccccgccacaggaagcggctctgctatcgcttccggcgtcgccgtctgcaaagtcctccacctcgaaggcgaagtaaacaaaatcaagtcagccctcctctccaccaacaaagccgtcgtctctctctcaaacggcgtatccgtcctcacattcaaagtcctcgacctcaaaaactacatcgacaaacaacttctccccatcctaaacaaacaatcatgctccatccccaaccccgaaacagtcatggaatttcaacaaaagaacaaccgcctcttagaaatcacccgagaattttccgtcaacgcgggagtcacaacccccgtttctacgtatatgctcaccaactccgaactcctttccctcataaacgacatgccaatcaccaacgaccaaaagaaactcatgtcaaacaacgtccaaatcgtccgacaacaatcctactctattatgtgcatcatcaaagaagaagttctcgcctacgtcgtccaactacccctctacggcgtgatcgacaccccctgctggaaactacacacctcacccctctgcaccaccaacaccaaggaaggctccaacatctgcctcacccgcaccgaccgcggctggtactgcgacaacgctggctccgtctcattcttcccgcaagccgaaacttgcaaagtatgctccaacagagtattctgcgacaccatgaactcactaaccctcccttccgaagtcaacctttgcaacgttgacatattcaacccaaagtacgattgcaaaattatgacatccaaaacagatgtctcctcctccgtcatcacatccctcggtgccattgtatcatgctacggaaaaaccaaatgcaccgcatccaacaaaaacaaaggaatcatcaaaaccttctcaaacggctgcgattacgtctcaaacaaaggagtcgacacagtctccgtcggaaacaccctatactacgtcaacaaacaagaaggccaatccctgtacgtcaaaggagaacccatcatcaacttctacgaccccctcgtcttcccgagcgacgagttcgacgcctccatctcacaagtcaatgaaaagatcaaccaatcccttgccttcatccggaaatcggacgaactcctacacaacgtgaacgctggaaaatcaaccaccaacatcatgatcacaaccatcattatcgtcatcatcgtcatactcctctccctaatcgccgtcggcctcctcctgtattgcaaagctcgctccacccccgtcaccctgtccaaagaccaactctccggaatcaacaacatcgccttctcaaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6257 - RNA, 1943 nt, synthetic construct
  misc_feature 1..1943: note = mRNA product Design e-4 comprising derived and/or modified sequence from HRSV(A2)__F_DSCav1_mut6 (opt1)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaaccccgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6258 - RNA, 1943 nt, synthetic construct
  misc_feature 1..1943: note = mRNA product Design e-4 comprising derived and/or modified sequence from HRSV(A2)__F_DSCav1_mut6 (opt1)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctcatgtgcagcacccccgccaccgggtccggcagcgccatcgcctccggcgtggcggtgtgcaaggtcctgcacctggagggggaggtgaacaagatcaagagcgccctcctgtccaccaacaaggccgtggtcagcctgtccaacggcgtgagcgtgctcacgttcaaggtcctggacctgaagaactacatcgacaagcagctcctgccgatcctgaacaagcagtcctgcagcatccccaaccccgagaccgtgatggagttccagcagaagaacaaccggctcctggagatcacccgcgagttctccgtgaacgccggggtcaccacgcccgtgagcacctacatgctgaccaactccgagctcctgagcctgatcaacgacatgccgatcaccaacgaccagaagaagctcatgagcaacaacgtgcagatcgtccggcagcagtcctacagcatcatgtgcatcatcaaggaggaggtgctggcctacgtggtccagctgcccctctacggcgtgatcgacacgccctgctggaagctgcacaccagccccctgtgcaccaccaacacgaaggaggggagcaacatctgcctcacccgcaccgaccggggctggtactgcgacaacgcgggctccgtgagcttcttcccgcaggccgagacctgcaaggtctgctccaaccgcgtgttctgcgacacgatgaacagcctgaccctgccctccgaggtcaacctctgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaacaaggggatcatcaagaccttctccaacggctgcgactacgtgagcaacaagggcgtcgacacggtgtccgtggggaacaccctgtactacgtcaacaagcaggagggccagagcctctacgtgaagggggagcccatcatcaacttctacgacccgctggtgttccccagcgacgagttcgacgcctccatcagccaggtcaacgagaagatcaaccagtccctggcgttcatccggaagtccgacgagctcctgcacaacgtgaacgccggcaagtccaccaccaacatcatgatcaccacgatcatcatcgtgatcatcgtcatcctgctcagcctgatcgccgtggggctgctcctgtactgcaaggcccgctccacccccgtgaccctgagcaaggaccagctgtccggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6259 - RNA, 1943 nt, synthetic construct
  misc_feature 1..1943: note = mRNA product Design e-4 comprising derived and/or modified sequence from HRSV(A2)__F_DSCav1_mut6 (opt2)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6260 - RNA, 1943 nt, synthetic construct
  misc_feature 1..1943: note = mRNA product Design e-4 comprising derived and/or modified sequence from HRSV(A2)__F_DSCav1_mut6 (opt3)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagatgcttatgtgttccacacccgccaccgggtctggatcggctatagcatcaggcgtggccgtctgcaaggtgctgcacttggagggtgaggttaacaaaatcaagagcgctctcctgagtacgaataaagccgtggtctccctgtctaacggggtgagcgtactcacttttaaggttttagatctgaagaattacattgacaaacagcttttgcctatcctgaacaagcaatcctgttcaattccaaatccggaaaccgtgatggagttccagcagaaaaacaataggctactcgaaatcacacgggagtttagtgtcaacgcgggagtgactacccccgtgagcacatatatgctgaccaattctgagcttctgtccttgataaacgatatgcctattacgaacgaccagaagaaactcatgtcaaataacgtccaaatcgttcgccagcagagctacagtattatgtgcatcatcaaggaagaggtgctggcatatgtagtgcagttaccactgtacggcgtcattgatactccctgttggaaactccatacatctcctctttgcaccactaatacaaaggaaggctccaacatatgtctgacccgaacggaccgtgggtggtactgcgataatgccggaagcgtgtcgttctttccacaagctgagacctgtaaggtttgctctaacagagtgttctgcgacacaatgaactccttgactctaccctcagaagtcaatctgtgtaatgtggatatctttaaccctaaatatgactgcaagattatgaccagtaaaacagatgtaagctcctctgttatcactagcctcggtgccatagtgtcatgttacggcaagaccaaatgcacagcaagtaataagaacaaggggattatcaaaaccttctccaatggatgtgactatgtcagcaacaagggcgtggacactgtctctgtgggtaatacgctgtactatgttaacaaacaggaggggcagtcactttacgtgaagggagagccaatcattaacttttatgatccgctggtattccccagtgacgaatttgatgctagcatctcccaagtcaatgagaaaattaaccagtctttggccttcataaggaagtcggacgaactcctgcacaatgtgaacgcgggcaagagcacaaccaatatcatgattactaccatcatcattgttataatcgtgattttactgtccctaatcgccgtcggcctcctgctttactgcaaagcacggtcaacacctgtgaccttgagtaaggatcagctgtctgggattaacaatatcgctttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6261 - RNA, 1943 nt, synthetic construct
  misc_feature 1..1943: note = mRNA product Design e-4 comprising derived and/or modified sequence from HRSV(A2)__F_DSCav1_mut6 (opt4)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6262 - RNA, 1943 nt, synthetic construct
  misc_feature 1..1943: note = mRNA product Design e-4 comprising derived and/or modified sequence from HRSV(A2)__F_DSCav1_mut6 (opt5)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagatgctgatgtgtagcacccccgccacaggatccggctctgctattgccagcggggtcgcggtgtgcaaggttctgcacctcgagggagaggtgaacaaaatcaagtccgccctgcttagcaccaataaagctgtcgtgtctctgtccaacggcgttagcgtgctcacatttaaggtcctggatcttaagaattacattgacaaacagctgctccctatcctgaacaagcaatcttgttccattccgaatcccgaaaccgtgatggagttccagcagaaaaacaatcggctgctcgaaatcacgcgcgagtttagcgtgaacgccggcgtcacaacccctgtttctacatatatgctgaccaattccgagcttctgagcctcattaacgatatgcccatcaccaacgaccagaagaaactgatgtccaataacgtgcaaatcgtgagacagcagtcttacagcattatgtgcatcattaaggaagaggtccttgcttatgtggttcagctgcctctctacggggtgatcgatacaccctgttggaaactgcatacgtcccctctgtgcaccacaaataccaaggaaggaagcaacatttgtctcacacggaccgaccgcggctggtactgcgataatgccgggtctgtctccttctttccgcaagcggagacgtgtaaggtgtgcagcaacagagttttctgcgacacaatgaactctctgacccttcccagcgaagtgaatctgtgtaatgtcgatatctttaaccctaaatatgactgcaagatcatgacctccaaaacagatgtgtctagctccgtcattaccagcctcggagccatcgtgtcttgttacggcaagacaaaatgcacggcttccaataagaacaaggggattatcaaaaccttcagcaatggatgtgactatgtttctaacaagggcgtggacacagtctccgtgggcaataccctgtactatgttaacaaacaggaggggcagagcctttacgtgaagggagagcccattatcaacttttatgatcctctggtcttcccctccgacgaatttgatgcctctatcagccaagtgaatgagaaaattaaccagtccctcgctttcatccggaagtctgacgaactgctgcacaatgtgaacgccggcaagagcacaaccaatattatgatcacgaccattatcattgttatcatcgtcattctcctgtcccttatcgccgtggggctgctcctgtactgcaaagctcgcagcacaccggtgaccctgtctaaggatcagctttccggaattaacaatatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6263 - RNA, 1943 nt, synthetic construct
  misc_feature 1..1943: note = mRNA product Design e-4 comprising derived and/or modified sequence from HRSV(A2)__F_DSCav1_mut6 (opt6)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactattaatcttaaaagcaaatgctataaccacaatattaacagcagtaacattctgttttgcctccggacaaaacataacagaagaattttatcaatcaacatgctctgcagtatccaaaggttacttaggcgcactacgcactggatggtatacatcagtaataacaatagaactatcaaacataaaagaaaataaatgtaacggtactgacgcaaaagtgaaactaattaaacaagaactcgacaaatacaaaaatgctgtaacagacctacaaatgctaatgtgctcaacacccgcaaccggatcaggatcagccatagcctccggagtcgcagtatgcaaagtattacatcttgaaggagaagtaaataaaataaaatcagcattactatccacaaataaagccgtagtatcactatcaaacggtgtatccgtccttacattcaaagtattagatctaaaaaactacatagataaacaactactacccatcttaaacaaacaatcatgctcaattcccaacccagaaacagtcatggaatttcaacaaaaaaacaacagactcttagaaataacacgagaattttcagtaaacgcaggagtaaccacaccagtaagtacatacatgctcaccaactcagaattattatcacttattaacgacatgccaattacaaacgaccaaaaaaaattaatgtcaaacaatgtccaaattgttagacaacaatcatactctataatgtgtataataaaagaagaagtactagcttacgtagttcaattaccactatatggcgtaatagatacaccttgctggaaactacatacatctccattatgtacaactaacacaaaagaaggatctaacatatgcctaacacgcacagatcgaggatggtactgcgataatgcaggttccgtatcattctttccacaagcagaaacatgtaaagtatgctcaaacagagtattctgtgacactatgaactccttaaccctaccctcagaagtcaatctatgcaacgttgacatatttaacccaaaatacgactgtaaaatcatgacatctaaaacagacgtatcatcatcagttattacatccctaggagcaatagtatcttgctacggaaaaacaaaatgtacagcatccaacaaaaacaaaggaataatcaaaacattctcaaacggctgcgactacgtatcaaacaaaggtgtagacacagtatcagtaggaaatactttatattacgtaaataaacaagaaggacaatctctatacgttaaaggcgaacctattataaacttctacgacccactcgtattcccttcagacgaatttgacgcatctatatcccaagttaacgaaaaaatcaaccaatcattagcctttataagaaaatccgacgaattattacataacgtcaacgctggaaaatcaacaactaacataatgataaccacaataataatagtcatcatagttatattactaagtctaatagccgtaggcctcctactttattgcaaagcaagatcaacaccagtaacattatccaaagaccaactcagcggcataaacaatatagctttttcaaactagggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6264 - RNA, 1943 nt, synthetic construct
  misc_feature 1..1943: note = mRNA product Design e-4 comprising derived and/or modified sequence from HRSV(A2)__F_DSCav1_mut6 (opt11)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactcctcatcctcaaagccaacgcaatcacaaccatactaactgcagttactttctgcttcgcatccggccaaaacatcaccgaagagttctaccaatcaacctgctccgcagtctccaaaggatacctcggagcccttcgcaccggctggtacacctccgtcataaccatcgaactctcaaacataaaagaaaacaaatgcaacggcacagacgcgaaagtcaaacttatcaaacaagaactcgacaaatacaaaaacgccgtcaccgacctgcagatgctcatgtgctcaacccccgccacaggaagcggctctgctatcgcttccggcgtcgccgtctgcaaagtcctccacctcgaaggcgaagtaaacaaaatcaagtcagccctcctctccaccaacaaagccgtcgtctctctctcaaacggcgtatccgtcctcacattcaaagtcctcgacctcaaaaactacatcgacaaacaacttctccccatcctaaacaaacaatcatgctccatccccaaccccgaaacagtcatggaatttcaacaaaagaacaaccgcctcttagaaatcacccgagaattttccgtcaacgcgggagtcacaacccccgtttctacgtatatgctcaccaactccgaactcctttccctcataaacgacatgccaatcaccaacgaccaaaagaaactcatgtcaaacaacgtccaaatcgtccgacaacaatcctactctattatgtgcatcatcaaagaagaagttctcgcctacgtcgtccaactacccctctacggcgtgatcgacaccccctgctggaaactacacacctcacccctctgcaccaccaacaccaaggaaggctccaacatctgcctcacccgcaccgaccgcggctggtactgcgacaacgctggctccgtctcattcttcccgcaagccgaaacttgcaaagtatgctccaacagagtattctgcgacaccatgaactcactaaccctcccttccgaagtcaacctttgcaacgttgacatattcaacccaaagtacgattgcaaaattatgacatccaaaacagatgtctcctcctccgtcatcacatccctcggtgccattgtatcatgctacggaaaaaccaaatgcaccgcatccaacaaaaacaaaggaatcatcaaaaccttctcaaacggctgcgattacgtctcaaacaaaggagtcgacacagtctccgtcggaaacaccctatactacgtcaacaaacaagaaggccaatccctgtacgtcaaaggagaacccatcatcaacttctacgaccccctcgtcttcccgagcgacgagttcgacgcctccatctcacaagtcaatgaaaagatcaaccaatcccttgccttcatccggaaatcggacgaactcctacacaacgtgaacgctggaaaatcaaccaccaacatcatgatcacaaccatcattatcgtcatcatcgtcatactcctctccctaatcgccgtcggcctcctcctgtattgcaaagctcgctccacccccgtcaccctgtccaaagaccaactctccggaatcaacaacatcgccttctcaaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6265 - RNA, 1910 nt, synthetic construct
  misc_feature 1..1910: note = mRNA product Design e-5 comprising derived and/or modified sequence from HRSV(A2)__F_DSCav1_mut6 (opt1)
  source 1..1910: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaaccccgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6266 - RNA, 1910 nt, synthetic construct
  misc_feature 1..1910: note = mRNA product Design e-5 comprising derived and/or modified sequence from HRSV(A2)__F_DSCav1_mut6 (opt1)
  source 1..1910: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctcatgtgcagcacccccgccaccgggtccggcagcgccatcgcctccggcgtggcggtgtgcaaggtcctgcacctggagggggaggtgaacaagatcaagagcgccctcctgtccaccaacaaggccgtggtcagcctgtccaacggcgtgagcgtgctcacgttcaaggtcctggacctgaagaactacatcgacaagcagctcctgccgatcctgaacaagcagtcctgcagcatccccaaccccgagaccgtgatggagttccagcagaagaacaaccggctcctggagatcacccgcgagttctccgtgaacgccggggtcaccacgcccgtgagcacctacatgctgaccaactccgagctcctgagcctgatcaacgacatgccgatcaccaacgaccagaagaagctcatgagcaacaacgtgcagatcgtccggcagcagtcctacagcatcatgtgcatcatcaaggaggaggtgctggcctacgtggtccagctgcccctctacggcgtgatcgacacgccctgctggaagctgcacaccagccccctgtgcaccaccaacacgaaggaggggagcaacatctgcctcacccgcaccgaccggggctggtactgcgacaacgcgggctccgtgagcttcttcccgcaggccgagacctgcaaggtctgctccaaccgcgtgttctgcgacacgatgaacagcctgaccctgccctccgaggtcaacctctgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaacaaggggatcatcaagaccttctccaacggctgcgactacgtgagcaacaagggcgtcgacacggtgtccgtggggaacaccctgtactacgtcaacaagcaggagggccagagcctctacgtgaagggggagcccatcatcaacttctacgacccgctggtgttccccagcgacgagttcgacgcctccatcagccaggtcaacgagaagatcaaccagtccctggcgttcatccggaagtccgacgagctcctgcacaacgtgaacgccggcaagtccaccaccaacatcatgatcaccacgatcatcatcgtgatcatcgtcatcctgctcagcctgatcgccgtggggctgctcctgtactgcaaggcccgctccacccccgtgaccctgagcaaggaccagctgtccggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6267 - RNA, 1910 nt, synthetic construct
  misc_feature 1..1910: note = mRNA product Design e-5 comprising derived and/or modified sequence from HRSV(A2)__F_DSCav1_mut6 (opt2)
  source 1..1910: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6268 - RNA, 1910 nt, synthetic construct
  misc_feature 1..1910: note = mRNA product Design e-5 comprising derived and/or modified sequence from HRSV(A2)__F_DSCav1_mut6 (opt3)
  source 1..1910: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagatgcttatgtgttccacacccgccaccgggtctggatcggctatagcatcaggcgtggccgtctgcaaggtgctgcacttggagggtgaggttaacaaaatcaagagcgctctcctgagtacgaataaagccgtggtctccctgtctaacggggtgagcgtactcacttttaaggttttagatctgaagaattacattgacaaacagcttttgcctatcctgaacaagcaatcctgttcaattccaaatccggaaaccgtgatggagttccagcagaaaaacaataggctactcgaaatcacacgggagtttagtgtcaacgcgggagtgactacccccgtgagcacatatatgctgaccaattctgagcttctgtccttgataaacgatatgcctattacgaacgaccagaagaaactcatgtcaaataacgtccaaatcgttcgccagcagagctacagtattatgtgcatcatcaaggaagaggtgctggcatatgtagtgcagttaccactgtacggcgtcattgatactccctgttggaaactccatacatctcctctttgcaccactaatacaaaggaaggctccaacatatgtctgacccgaacggaccgtgggtggtactgcgataatgccggaagcgtgtcgttctttccacaagctgagacctgtaaggtttgctctaacagagtgttctgcgacacaatgaactccttgactctaccctcagaagtcaatctgtgtaatgtggatatctttaaccctaaatatgactgcaagattatgaccagtaaaacagatgtaagctcctctgttatcactagcctcggtgccatagtgtcatgttacggcaagaccaaatgcacagcaagtaataagaacaaggggattatcaaaaccttctccaatggatgtgactatgtcagcaacaagggcgtggacactgtctctgtgggtaatacgctgtactatgttaacaaacaggaggggcagtcactttacgtgaagggagagccaatcattaacttttatgatccgctggtattccccagtgacgaatttgatgctagcatctcccaagtcaatgagaaaattaaccagtctttggccttcataaggaagtcggacgaactcctgcacaatgtgaacgcgggcaagagcacaaccaatatcatgattactaccatcatcattgttataatcgtgattttactgtccctaatcgccgtcggcctcctgctttactgcaaagcacggtcaacacctgtgaccttgagtaaggatcagctgtctgggattaacaatatcgctttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6269 - RNA, 1910 nt, synthetic construct
  misc_feature 1..1910: note = mRNA product Design e-5 comprising derived and/or modified sequence from HRSV(A2)__F_DSCav1_mut6 (opt4)
  source 1..1910: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6270 - RNA, 1910 nt, synthetic construct
  misc_feature 1..1910: note = mRNA product Design e-5 comprising derived and/or modified sequence from HRSV(A2)__F_DSCav1_mut6 (opt5)
  source 1..1910: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagatgctgatgtgtagcacccccgccacaggatccggctctgctattgccagcggggtcgcggtgtgcaaggttctgcacctcgagggagaggtgaacaaaatcaagtccgccctgcttagcaccaataaagctgtcgtgtctctgtccaacggcgttagcgtgctcacatttaaggtcctggatcttaagaattacattgacaaacagctgctccctatcctgaacaagcaatcttgttccattccgaatcccgaaaccgtgatggagttccagcagaaaaacaatcggctgctcgaaatcacgcgcgagtttagcgtgaacgccggcgtcacaacccctgtttctacatatatgctgaccaattccgagcttctgagcctcattaacgatatgcccatcaccaacgaccagaagaaactgatgtccaataacgtgcaaatcgtgagacagcagtcttacagcattatgtgcatcattaaggaagaggtccttgcttatgtggttcagctgcctctctacggggtgatcgatacaccctgttggaaactgcatacgtcccctctgtgcaccacaaataccaaggaaggaagcaacatttgtctcacacggaccgaccgcggctggtactgcgataatgccgggtctgtctccttctttccgcaagcggagacgtgtaaggtgtgcagcaacagagttttctgcgacacaatgaactctctgacccttcccagcgaagtgaatctgtgtaatgtcgatatctttaaccctaaatatgactgcaagatcatgacctccaaaacagatgtgtctagctccgtcattaccagcctcggagccatcgtgtcttgttacggcaagacaaaatgcacggcttccaataagaacaaggggattatcaaaaccttcagcaatggatgtgactatgtttctaacaagggcgtggacacagtctccgtgggcaataccctgtactatgttaacaaacaggaggggcagagcctttacgtgaagggagagcccattatcaacttttatgatcctctggtcttcccctccgacgaatttgatgcctctatcagccaagtgaatgagaaaattaaccagtccctcgctttcatccggaagtctgacgaactgctgcacaatgtgaacgccggcaagagcacaaccaatattatgatcacgaccattatcattgttatcatcgtcattctcctgtcccttatcgccgtggggctgctcctgtactgcaaagctcgcagcacaccggtgaccctgtctaaggatcagctttccggaattaacaatatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6271 - RNA, 1910 nt, synthetic construct
  misc_feature 1..1910: note = mRNA product Design e-5 comprising derived and/or modified sequence from HRSV(A2)__F_DSCav1_mut6 (opt6)
  source 1..1910: mol_type = other RNA
gggagagcggctcggccattttgtcccagtcagtccggaggctgcggctgcagaagtaccgcctgcggagtaactgcaaagaagcttaccatggaactattaatcttaaaagcaaatgctataaccacaatattaacagcagtaacattctgttttgcctccggacaaaacataacagaagaattttatcaatcaacatgctctgcagtatccaaaggttacttaggcgcactacgcactggatggtatacatcagtaataacaatagaactatcaaacataaaagaaaataaatgtaacggtactgacgcaaaagtgaaactaattaaacaagaactcgacaaatacaaaaatgctgtaacagacctacaaatgctaatgtgctcaacacccgcaaccggatcaggatcagccatagcctccggagtcgcagtatgcaaagtattacatcttgaaggagaagtaaataaaataaaatcagcattactatccacaaataaagccgtagtatcactatcaaacggtgtatccgtccttacattcaaagtattagatctaaaaaactacatagataaacaactactacccatcttaaacaaacaatcatgctcaattcccaacccagaaacagtcatggaatttcaacaaaaaaacaacagactcttagaaataacacgagaattttcagtaaacgcaggagtaaccacaccagtaagtacatacatgctcaccaactcagaattattatcacttattaacgacatgccaattacaaacgaccaaaaaaaattaatgtcaaacaatgtccaaattgttagacaacaatcatactctataatgtgtataataaaagaagaagtactagcttacgtagttcaattaccactatatggcgtaatagatacaccttgctggaaactacatacatctccattatgtacaactaacacaaaagaaggatctaacatatgcctaacacgcacagatcgaggatggtactgcgataatgcaggttccgtatcattctttccacaagcagaaacatgtaaagtatgctcaaacagagtattctgtgacactatgaactccttaaccctaccctcagaagtcaatctatgcaacgttgacatatttaacccaaaatacgactgtaaaatcatgacatctaaaacagacgtatcatcatcagttattacatccctaggagcaatagtatcttgctacggaaaaacaaaatgtacagcatccaacaaaaacaaaggaataatcaaaacattctcaaacggctgcgactacgtatcaaacaaaggtgtagacacagtatcagtaggaaatactttatattacgtaaataaacaagaaggacaatctctatacgttaaaggcgaacctattataaacttctacgacccactcgtattcccttcagacgaatttgacgcatctatatcccaagttaacgaaaaaatcaaccaatcattagcctttataagaaaatccgacgaattattacataacgtcaacgctggaaaatcaacaactaacataatgataaccacaataataatagtcatcatagttatattactaagtctaatagccgtaggcctcctactttattgcaaagcaagatcaacaccagtaacattatccaaagaccaactcagcggcataaacaatatagctttttcaaactagggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6272 - RNA, 1910 nt, synthetic construct
  misc_feature 1..1910: note = mRNA product Design e-5 comprising derived and/or modified sequence from HRSV(A2)__F_DSCav1_mut6 (opt11)
  source 1..1910: mol_type = other RNA
gggagagcggctcggccattttgtcccagtcagtccggaggctgcggctgcagaagtaccgcctgcggagtaactgcaaagaagcttaccatggaactcctcatcctcaaagccaacgcaatcacaaccatactaactgcagttactttctgcttcgcatccggccaaaacatcaccgaagagttctaccaatcaacctgctccgcagtctccaaaggatacctcggagcccttcgcaccggctggtacacctccgtcataaccatcgaactctcaaacataaaagaaaacaaatgcaacggcacagacgcgaaagtcaaacttatcaaacaagaactcgacaaatacaaaaacgccgtcaccgacctgcagatgctcatgtgctcaacccccgccacaggaagcggctctgctatcgcttccggcgtcgccgtctgcaaagtcctccacctcgaaggcgaagtaaacaaaatcaagtcagccctcctctccaccaacaaagccgtcgtctctctctcaaacggcgtatccgtcctcacattcaaagtcctcgacctcaaaaactacatcgacaaacaacttctccccatcctaaacaaacaatcatgctccatccccaaccccgaaacagtcatggaatttcaacaaaagaacaaccgcctcttagaaatcacccgagaattttccgtcaacgcgggagtcacaacccccgtttctacgtatatgctcaccaactccgaactcctttccctcataaacgacatgccaatcaccaacgaccaaaagaaactcatgtcaaacaacgtccaaatcgtccgacaacaatcctactctattatgtgcatcatcaaagaagaagttctcgcctacgtcgtccaactacccctctacggcgtgatcgacaccccctgctggaaactacacacctcacccctctgcaccaccaacaccaaggaaggctccaacatctgcctcacccgcaccgaccgcggctggtactgcgacaacgctggctccgtctcattcttcccgcaagccgaaacttgcaaagtatgctccaacagagtattctgcgacaccatgaactcactaaccctcccttccgaagtcaacctttgcaacgttgacatattcaacccaaagtacgattgcaaaattatgacatccaaaacagatgtctcctcctccgtcatcacatccctcggtgccattgtatcatgctacggaaaaaccaaatgcaccgcatccaacaaaaacaaaggaatcatcaaaaccttctcaaacggctgcgattacgtctcaaacaaaggagtcgacacagtctccgtcggaaacaccctatactacgtcaacaaacaagaaggccaatccctgtacgtcaaaggagaacccatcatcaacttctacgaccccctcgtcttcccgagcgacgagttcgacgcctccatctcacaagtcaatgaaaagatcaaccaatcccttgccttcatccggaaatcggacgaactcctacacaacgtgaacgctggaaaatcaaccaccaacatcatgatcacaaccatcattatcgtcatcatcgtcatactcctctccctaatcgccgtcggcctcctcctgtattgcaaagctcgctccacccccgtcaccctgtccaaagaccaactctccggaatcaacaacatcgccttctcaaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6273 - RNA, 1977 nt, synthetic construct
  misc_feature 1..1977: note = mRNA product Design e-6 comprising derived and/or modified sequence from HRSV(A2)__F_DSCav1_mut6 (opt1)
  source 1..1977: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaaccccgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6274 - RNA, 1977 nt, synthetic construct
  misc_feature 1..1977: note = mRNA product Design e-6 comprising derived and/or modified sequence from HRSV(A2)__F_DSCav1_mut6 (opt1)
  source 1..1977: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctcatgtgcagcacccccgccaccgggtccggcagcgccatcgcctccggcgtggcggtgtgcaaggtcctgcacctggagggggaggtgaacaagatcaagagcgccctcctgtccaccaacaaggccgtggtcagcctgtccaacggcgtgagcgtgctcacgttcaaggtcctggacctgaagaactacatcgacaagcagctcctgccgatcctgaacaagcagtcctgcagcatccccaaccccgagaccgtgatggagttccagcagaagaacaaccggctcctggagatcacccgcgagttctccgtgaacgccggggtcaccacgcccgtgagcacctacatgctgaccaactccgagctcctgagcctgatcaacgacatgccgatcaccaacgaccagaagaagctcatgagcaacaacgtgcagatcgtccggcagcagtcctacagcatcatgtgcatcatcaaggaggaggtgctggcctacgtggtccagctgcccctctacggcgtgatcgacacgccctgctggaagctgcacaccagccccctgtgcaccaccaacacgaaggaggggagcaacatctgcctcacccgcaccgaccggggctggtactgcgacaacgcgggctccgtgagcttcttcccgcaggccgagacctgcaaggtctgctccaaccgcgtgttctgcgacacgatgaacagcctgaccctgccctccgaggtcaacctctgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaacaaggggatcatcaagaccttctccaacggctgcgactacgtgagcaacaagggcgtcgacacggtgtccgtggggaacaccctgtactacgtcaacaagcaggagggccagagcctctacgtgaagggggagcccatcatcaacttctacgacccgctggtgttccccagcgacgagttcgacgcctccatcagccaggtcaacgagaagatcaaccagtccctggcgttcatccggaagtccgacgagctcctgcacaacgtgaacgccggcaagtccaccaccaacatcatgatcaccacgatcatcatcgtgatcatcgtcatcctgctcagcctgatcgccgtggggctgctcctgtactgcaaggcccgctccacccccgtgaccctgagcaaggaccagctgtccggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6275 - RNA, 1977 nt, synthetic construct
  misc_feature 1..1977: note = mRNA product Design e-6 comprising derived and/or modified sequence from HRSV(A2)__F_DSCav1_mut6 (opt2)
  source 1..1977: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6276 - RNA, 1977 nt, synthetic construct
  misc_feature 1..1977: note = mRNA product Design e-6 comprising derived and/or modified sequence from HRSV(A2)__F_DSCav1_mut6 (opt3)
  source 1..1977: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagatgcttatgtgttccacacccgccaccgggtctggatcggctatagcatcaggcgtggccgtctgcaaggtgctgcacttggagggtgaggttaacaaaatcaagagcgctctcctgagtacgaataaagccgtggtctccctgtctaacggggtgagcgtactcacttttaaggttttagatctgaagaattacattgacaaacagcttttgcctatcctgaacaagcaatcctgttcaattccaaatccggaaaccgtgatggagttccagcagaaaaacaataggctactcgaaatcacacgggagtttagtgtcaacgcgggagtgactacccccgtgagcacatatatgctgaccaattctgagcttctgtccttgataaacgatatgcctattacgaacgaccagaagaaactcatgtcaaataacgtccaaatcgttcgccagcagagctacagtattatgtgcatcatcaaggaagaggtgctggcatatgtagtgcagttaccactgtacggcgtcattgatactccctgttggaaactccatacatctcctctttgcaccactaatacaaaggaaggctccaacatatgtctgacccgaacggaccgtgggtggtactgcgataatgccggaagcgtgtcgttctttccacaagctgagacctgtaaggtttgctctaacagagtgttctgcgacacaatgaactccttgactctaccctcagaagtcaatctgtgtaatgtggatatctttaaccctaaatatgactgcaagattatgaccagtaaaacagatgtaagctcctctgttatcactagcctcggtgccatagtgtcatgttacggcaagaccaaatgcacagcaagtaataagaacaaggggattatcaaaaccttctccaatggatgtgactatgtcagcaacaagggcgtggacactgtctctgtgggtaatacgctgtactatgttaacaaacaggaggggcagtcactttacgtgaagggagagccaatcattaacttttatgatccgctggtattccccagtgacgaatttgatgctagcatctcccaagtcaatgagaaaattaaccagtctttggccttcataaggaagtcggacgaactcctgcacaatgtgaacgcgggcaagagcacaaccaatatcatgattactaccatcatcattgttataatcgtgattttactgtccctaatcgccgtcggcctcctgctttactgcaaagcacggtcaacacctgtgaccttgagtaaggatcagctgtctgggattaacaatatcgctttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6277 - RNA, 1977 nt, synthetic construct
  misc_feature 1..1977: note = mRNA product Design e-6 comprising derived and/or modified sequence from HRSV(A2)__F_DSCav1_mut6 (opt4)
  source 1..1977: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6278 - RNA, 1977 nt, synthetic construct
  misc_feature 1..1977: note = mRNA product Design e-6 comprising derived and/or modified sequence from HRSV(A2)__F_DSCav1_mut6 (opt5)
  source 1..1977: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagatgctgatgtgtagcacccccgccacaggatccggctctgctattgccagcggggtcgcggtgtgcaaggttctgcacctcgagggagaggtgaacaaaatcaagtccgccctgcttagcaccaataaagctgtcgtgtctctgtccaacggcgttagcgtgctcacatttaaggtcctggatcttaagaattacattgacaaacagctgctccctatcctgaacaagcaatcttgttccattccgaatcccgaaaccgtgatggagttccagcagaaaaacaatcggctgctcgaaatcacgcgcgagtttagcgtgaacgccggcgtcacaacccctgtttctacatatatgctgaccaattccgagcttctgagcctcattaacgatatgcccatcaccaacgaccagaagaaactgatgtccaataacgtgcaaatcgtgagacagcagtcttacagcattatgtgcatcattaaggaagaggtccttgcttatgtggttcagctgcctctctacggggtgatcgatacaccctgttggaaactgcatacgtcccctctgtgcaccacaaataccaaggaaggaagcaacatttgtctcacacggaccgaccgcggctggtactgcgataatgccgggtctgtctccttctttccgcaagcggagacgtgtaaggtgtgcagcaacagagttttctgcgacacaatgaactctctgacccttcccagcgaagtgaatctgtgtaatgtcgatatctttaaccctaaatatgactgcaagatcatgacctccaaaacagatgtgtctagctccgtcattaccagcctcggagccatcgtgtcttgttacggcaagacaaaatgcacggcttccaataagaacaaggggattatcaaaaccttcagcaatggatgtgactatgtttctaacaagggcgtggacacagtctccgtgggcaataccctgtactatgttaacaaacaggaggggcagagcctttacgtgaagggagagcccattatcaacttttatgatcctctggtcttcccctccgacgaatttgatgcctctatcagccaagtgaatgagaaaattaaccagtccctcgctttcatccggaagtctgacgaactgctgcacaatgtgaacgccggcaagagcacaaccaatattatgatcacgaccattatcattgttatcatcgtcattctcctgtcccttatcgccgtggggctgctcctgtactgcaaagctcgcagcacaccggtgaccctgtctaaggatcagctttccggaattaacaatatcgcgttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6279 - RNA, 1977 nt, synthetic construct
  misc_feature 1..1977: note = mRNA product Design e-6 comprising derived and/or modified sequence from HRSV(A2)__F_DSCav1_mut6 (opt6)
  source 1..1977: mol_type = other RNA
gggagagcggctcggccattttgtcccagtcagtccggaggctgcggctgcagaagtaccgcctgcggagtaactgcaaagaagcttaccatggaactattaatcttaaaagcaaatgctataaccacaatattaacagcagtaacattctgttttgcctccggacaaaacataacagaagaattttatcaatcaacatgctctgcagtatccaaaggttacttaggcgcactacgcactggatggtatacatcagtaataacaatagaactatcaaacataaaagaaaataaatgtaacggtactgacgcaaaagtgaaactaattaaacaagaactcgacaaatacaaaaatgctgtaacagacctacaaatgctaatgtgctcaacacccgcaaccggatcaggatcagccatagcctccggagtcgcagtatgcaaagtattacatcttgaaggagaagtaaataaaataaaatcagcattactatccacaaataaagccgtagtatcactatcaaacggtgtatccgtccttacattcaaagtattagatctaaaaaactacatagataaacaactactacccatcttaaacaaacaatcatgctcaattcccaacccagaaacagtcatggaatttcaacaaaaaaacaacagactcttagaaataacacgagaattttcagtaaacgcaggagtaaccacaccagtaagtacatacatgctcaccaactcagaattattatcacttattaacgacatgccaattacaaacgaccaaaaaaaattaatgtcaaacaatgtccaaattgttagacaacaatcatactctataatgtgtataataaaagaagaagtactagcttacgtagttcaattaccactatatggcgtaatagatacaccttgctggaaactacatacatctccattatgtacaactaacacaaaagaaggatctaacatatgcctaacacgcacagatcgaggatggtactgcgataatgcaggttccgtatcattctttccacaagcagaaacatgtaaagtatgctcaaacagagtattctgtgacactatgaactccttaaccctaccctcagaagtcaatctatgcaacgttgacatatttaacccaaaatacgactgtaaaatcatgacatctaaaacagacgtatcatcatcagttattacatccctaggagcaatagtatcttgctacggaaaaacaaaatgtacagcatccaacaaaaacaaaggaataatcaaaacattctcaaacggctgcgactacgtatcaaacaaaggtgtagacacagtatcagtaggaaatactttatattacgtaaataaacaagaaggacaatctctatacgttaaaggcgaacctattataaacttctacgacccactcgtattcccttcagacgaatttgacgcatctatatcccaagttaacgaaaaaatcaaccaatcattagcctttataagaaaatccgacgaattattacataacgtcaacgctggaaaatcaacaactaacataatgataaccacaataataatagtcatcatagttatattactaagtctaatagccgtaggcctcctactttattgcaaagcaagatcaacaccagtaacattatccaaagaccaactcagcggcataaacaatatagctttttcaaactagggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6280 - RNA, 1977 nt, synthetic construct
  misc_feature 1..1977: note = mRNA product Design e-6 comprising derived and/or modified sequence from HRSV(A2)__F_DSCav1_mut6 (opt11)
  source 1..1977: mol_type = other RNA
gggagagcggctcggccattttgtcccagtcagtccggaggctgcggctgcagaagtaccgcctgcggagtaactgcaaagaagcttaccatggaactcctcatcctcaaagccaacgcaatcacaaccatactaactgcagttactttctgcttcgcatccggccaaaacatcaccgaagagttctaccaatcaacctgctccgcagtctccaaaggatacctcggagcccttcgcaccggctggtacacctccgtcataaccatcgaactctcaaacataaaagaaaacaaatgcaacggcacagacgcgaaagtcaaacttatcaaacaagaactcgacaaatacaaaaacgccgtcaccgacctgcagatgctcatgtgctcaacccccgccacaggaagcggctctgctatcgcttccggcgtcgccgtctgcaaagtcctccacctcgaaggcgaagtaaacaaaatcaagtcagccctcctctccaccaacaaagccgtcgtctctctctcaaacggcgtatccgtcctcacattcaaagtcctcgacctcaaaaactacatcgacaaacaacttctccccatcctaaacaaacaatcatgctccatccccaaccccgaaacagtcatggaatttcaacaaaagaacaaccgcctcttagaaatcacccgagaattttccgtcaacgcgggagtcacaacccccgtttctacgtatatgctcaccaactccgaactcctttccctcataaacgacatgccaatcaccaacgaccaaaagaaactcatgtcaaacaacgtccaaatcgtccgacaacaatcctactctattatgtgcatcatcaaagaagaagttctcgcctacgtcgtccaactacccctctacggcgtgatcgacaccccctgctggaaactacacacctcacccctctgcaccaccaacaccaaggaaggctccaacatctgcctcacccgcaccgaccgcggctggtactgcgacaacgctggctccgtctcattcttcccgcaagccgaaacttgcaaagtatgctccaacagagtattctgcgacaccatgaactcactaaccctcccttccgaagtcaacctttgcaacgttgacatattcaacccaaagtacgattgcaaaattatgacatccaaaacagatgtctcctcctccgtcatcacatccctcggtgccattgtatcatgctacggaaaaaccaaatgcaccgcatccaacaaaaacaaaggaatcatcaaaaccttctcaaacggctgcgattacgtctcaaacaaaggagtcgacacagtctccgtcggaaacaccctatactacgtcaacaaacaagaaggccaatccctgtacgtcaaaggagaacccatcatcaacttctacgaccccctcgtcttcccgagcgacgagttcgacgcctccatctcacaagtcaatgaaaagatcaaccaatcccttgccttcatccggaaatcggacgaactcctacacaacgtgaacgctggaaaatcaaccaccaacatcatgatcacaaccatcattatcgtcatcatcgtcatactcctctccctaatcgccgtcggcctcctcctgtattgcaaagctcgctccacccccgtcaccctgtccaaagaccaactctccggaatcaacaacatcgccttctcaaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6281 - RNA, 2193 nt, synthetic construct
  misc_feature 1..2193: note = mRNA product Design f-1 comprising derived and/or modified sequence from HRSV(A2)__F_DSCav1_mut6 (opt1)
  source 1..2193: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaaccccgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6282 - RNA, 2193 nt, synthetic construct
  misc_feature 1..2193: note = mRNA product Design f-1 comprising derived and/or modified sequence from HRSV(A2)__F_DSCav1_mut6 (opt1)
  source 1..2193: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctcatgtgcagcacccccgccaccgggtccggcagcgccatcgcctccggcgtggcggtgtgcaaggtcctgcacctggagggggaggtgaacaagatcaagagcgccctcctgtccaccaacaaggccgtggtcagcctgtccaacggcgtgagcgtgctcacgttcaaggtcctggacctgaagaactacatcgacaagcagctcctgccgatcctgaacaagcagtcctgcagcatccccaaccccgagaccgtgatggagttccagcagaagaacaaccggctcctggagatcacccgcgagttctccgtgaacgccggggtcaccacgcccgtgagcacctacatgctgaccaactccgagctcctgagcctgatcaacgacatgccgatcaccaacgaccagaagaagctcatgagcaacaacgtgcagatcgtccggcagcagtcctacagcatcatgtgcatcatcaaggaggaggtgctggcctacgtggtccagctgcccctctacggcgtgatcgacacgccctgctggaagctgcacaccagccccctgtgcaccaccaacacgaaggaggggagcaacatctgcctcacccgcaccgaccggggctggtactgcgacaacgcgggctccgtgagcttcttcccgcaggccgagacctgcaaggtctgctccaaccgcgtgttctgcgacacgatgaacagcctgaccctgccctccgaggtcaacctctgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaacaaggggatcatcaagaccttctccaacggctgcgactacgtgagcaacaagggcgtcgacacggtgtccgtggggaacaccctgtactacgtcaacaagcaggagggccagagcctctacgtgaagggggagcccatcatcaacttctacgacccgctggtgttccccagcgacgagttcgacgcctccatcagccaggtcaacgagaagatcaaccagtccctggcgttcatccggaagtccgacgagctcctgcacaacgtgaacgccggcaagtccaccaccaacatcatgatcaccacgatcatcatcgtgatcatcgtcatcctgctcagcctgatcgccgtggggctgctcctgtactgcaaggcccgctccacccccgtgaccctgagcaaggaccagctgtccggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6283 - RNA, 2193 nt, synthetic construct
  misc_feature 1..2193: note = mRNA product Design f-1 comprising derived and/or modified sequence from HRSV(A2)__F_DSCav1_mut6 (opt2)
  source 1..2193: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6284 - RNA, 2193 nt, synthetic construct
  misc_feature 1..2193: note = mRNA product Design f-1 comprising derived and/or modified sequence from HRSV(A2)__F_DSCav1_mut6 (opt3)
  source 1..2193: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagatgcttatgtgttccacacccgccaccgggtctggatcggctatagcatcaggcgtggccgtctgcaaggtgctgcacttggagggtgaggttaacaaaatcaagagcgctctcctgagtacgaataaagccgtggtctccctgtctaacggggtgagcgtactcacttttaaggttttagatctgaagaattacattgacaaacagcttttgcctatcctgaacaagcaatcctgttcaattccaaatccggaaaccgtgatggagttccagcagaaaaacaataggctactcgaaatcacacgggagtttagtgtcaacgcgggagtgactacccccgtgagcacatatatgctgaccaattctgagcttctgtccttgataaacgatatgcctattacgaacgaccagaagaaactcatgtcaaataacgtccaaatcgttcgccagcagagctacagtattatgtgcatcatcaaggaagaggtgctggcatatgtagtgcagttaccactgtacggcgtcattgatactccctgttggaaactccatacatctcctctttgcaccactaatacaaaggaaggctccaacatatgtctgacccgaacggaccgtgggtggtactgcgataatgccggaagcgtgtcgttctttccacaagctgagacctgtaaggtttgctctaacagagtgttctgcgacacaatgaactccttgactctaccctcagaagtcaatctgtgtaatgtggatatctttaaccctaaatatgactgcaagattatgaccagtaaaacagatgtaagctcctctgttatcactagcctcggtgccatagtgtcatgttacggcaagaccaaatgcacagcaagtaataagaacaaggggattatcaaaaccttctccaatggatgtgactatgtcagcaacaagggcgtggacactgtctctgtgggtaatacgctgtactatgttaacaaacaggaggggcagtcactttacgtgaagggagagccaatcattaacttttatgatccgctggtattccccagtgacgaatttgatgctagcatctcccaagtcaatgagaaaattaaccagtctttggccttcataaggaagtcggacgaactcctgcacaatgtgaacgcgggcaagagcacaaccaatatcatgattactaccatcatcattgttataatcgtgattttactgtccctaatcgccgtcggcctcctgctttactgcaaagcacggtcaacacctgtgaccttgagtaaggatcagctgtctgggattaacaatatcgctttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6285 - RNA, 2193 nt, synthetic construct
  misc_feature 1..2193: note = mRNA product Design f-1 comprising derived and/or modified sequence from HRSV(A2)__F_DSCav1_mut6 (opt4)
  source 1..2193: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6286 - RNA, 2193 nt, synthetic construct
  misc_feature 1..2193: note = mRNA product Design f-1 comprising derived and/or modified sequence from HRSV(A2)__F_DSCav1_mut6 (opt5)
  source 1..2193: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagatgctgatgtgtagcacccccgccacaggatccggctctgctattgccagcggggtcgcggtgtgcaaggttctgcacctcgagggagaggtgaacaaaatcaagtccgccctgcttagcaccaataaagctgtcgtgtctctgtccaacggcgttagcgtgctcacatttaaggtcctggatcttaagaattacattgacaaacagctgctccctatcctgaacaagcaatcttgttccattccgaatcccgaaaccgtgatggagttccagcagaaaaacaatcggctgctcgaaatcacgcgcgagtttagcgtgaacgccggcgtcacaacccctgtttctacatatatgctgaccaattccgagcttctgagcctcattaacgatatgcccatcaccaacgaccagaagaaactgatgtccaataacgtgcaaatcgtgagacagcagtcttacagcattatgtgcatcattaaggaagaggtccttgcttatgtggttcagctgcctctctacggggtgatcgatacaccctgttggaaactgcatacgtcccctctgtgcaccacaaataccaaggaaggaagcaacatttgtctcacacggaccgaccgcggctggtactgcgataatgccgggtctgtctccttctttccgcaagcggagacgtgtaaggtgtgcagcaacagagttttctgcgacacaatgaactctctgacccttcccagcgaagtgaatctgtgtaatgtcgatatctttaaccctaaatatgactgcaagatcatgacctccaaaacagatgtgtctagctccgtcattaccagcctcggagccatcgtgtcttgttacggcaagacaaaatgcacggcttccaataagaacaaggggattatcaaaaccttcagcaatggatgtgactatgtttctaacaagggcgtggacacagtctccgtgggcaataccctgtactatgttaacaaacaggaggggcagagcctttacgtgaagggagagcccattatcaacttttatgatcctctggtcttcccctccgacgaatttgatgcctctatcagccaagtgaatgagaaaattaaccagtccctcgctttcatccggaagtctgacgaactgctgcacaatgtgaacgccggcaagagcacaaccaatattatgatcacgaccattatcattgttatcatcgtcattctcctgtcccttatcgccgtggggctgctcctgtactgcaaagctcgcagcacaccggtgaccctgtctaaggatcagctttccggaattaacaatatcgcgttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6287 - RNA, 2193 nt, synthetic construct
  misc_feature 1..2193: note = mRNA product Design f-1 comprising derived and/or modified sequence from HRSV(A2)__F_DSCav1_mut6 (opt6)
  source 1..2193: mol_type = other RNA
gggagagcggctcggccattttgtcccagtcagtccggaggctgcggctgcagaagtaccgcctgcggagtaactgcaaagaagcttaccatggaactattaatcttaaaagcaaatgctataaccacaatattaacagcagtaacattctgttttgcctccggacaaaacataacagaagaattttatcaatcaacatgctctgcagtatccaaaggttacttaggcgcactacgcactggatggtatacatcagtaataacaatagaactatcaaacataaaagaaaataaatgtaacggtactgacgcaaaagtgaaactaattaaacaagaactcgacaaatacaaaaatgctgtaacagacctacaaatgctaatgtgctcaacacccgcaaccggatcaggatcagccatagcctccggagtcgcagtatgcaaagtattacatcttgaaggagaagtaaataaaataaaatcagcattactatccacaaataaagccgtagtatcactatcaaacggtgtatccgtccttacattcaaagtattagatctaaaaaactacatagataaacaactactacccatcttaaacaaacaatcatgctcaattcccaacccagaaacagtcatggaatttcaacaaaaaaacaacagactcttagaaataacacgagaattttcagtaaacgcaggagtaaccacaccagtaagtacatacatgctcaccaactcagaattattatcacttattaacgacatgccaattacaaacgaccaaaaaaaattaatgtcaaacaatgtccaaattgttagacaacaatcatactctataatgtgtataataaaagaagaagtactagcttacgtagttcaattaccactatatggcgtaatagatacaccttgctggaaactacatacatctccattatgtacaactaacacaaaagaaggatctaacatatgcctaacacgcacagatcgaggatggtactgcgataatgcaggttccgtatcattctttccacaagcagaaacatgtaaagtatgctcaaacagagtattctgtgacactatgaactccttaaccctaccctcagaagtcaatctatgcaacgttgacatatttaacccaaaatacgactgtaaaatcatgacatctaaaacagacgtatcatcatcagttattacatccctaggagcaatagtatcttgctacggaaaaacaaaatgtacagcatccaacaaaaacaaaggaataatcaaaacattctcaaacggctgcgactacgtatcaaacaaaggtgtagacacagtatcagtaggaaatactttatattacgtaaataaacaagaaggacaatctctatacgttaaaggcgaacctattataaacttctacgacccactcgtattcccttcagacgaatttgacgcatctatatcccaagttaacgaaaaaatcaaccaatcattagcctttataagaaaatccgacgaattattacataacgtcaacgctggaaaatcaacaactaacataatgataaccacaataataatagtcatcatagttatattactaagtctaatagccgtaggcctcctactttattgcaaagcaagatcaacaccagtaacattatccaaagaccaactcagcggcataaacaatatagctttttcaaactagggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6288 - RNA, 2193 nt, synthetic construct
  misc_feature 1..2193: note = mRNA product Design f-1 comprising derived and/or modified sequence from HRSV(A2)__F_DSCav1_mut6 (opt11)
  source 1..2193: mol_type = other RNA
gggagagcggctcggccattttgtcccagtcagtccggaggctgcggctgcagaagtaccgcctgcggagtaactgcaaagaagcttaccatggaactcctcatcctcaaagccaacgcaatcacaaccatactaactgcagttactttctgcttcgcatccggccaaaacatcaccgaagagttctaccaatcaacctgctccgcagtctccaaaggatacctcggagcccttcgcaccggctggtacacctccgtcataaccatcgaactctcaaacataaaagaaaacaaatgcaacggcacagacgcgaaagtcaaacttatcaaacaagaactcgacaaatacaaaaacgccgtcaccgacctgcagatgctcatgtgctcaacccccgccacaggaagcggctctgctatcgcttccggcgtcgccgtctgcaaagtcctccacctcgaaggcgaagtaaacaaaatcaagtcagccctcctctccaccaacaaagccgtcgtctctctctcaaacggcgtatccgtcctcacattcaaagtcctcgacctcaaaaactacatcgacaaacaacttctccccatcctaaacaaacaatcatgctccatccccaaccccgaaacagtcatggaatttcaacaaaagaacaaccgcctcttagaaatcacccgagaattttccgtcaacgcgggagtcacaacccccgtttctacgtatatgctcaccaactccgaactcctttccctcataaacgacatgccaatcaccaacgaccaaaagaaactcatgtcaaacaacgtccaaatcgtccgacaacaatcctactctattatgtgcatcatcaaagaagaagttctcgcctacgtcgtccaactacccctctacggcgtgatcgacaccccctgctggaaactacacacctcacccctctgcaccaccaacaccaaggaaggctccaacatctgcctcacccgcaccgaccgcggctggtactgcgacaacgctggctccgtctcattcttcccgcaagccgaaacttgcaaagtatgctccaacagagtattctgcgacaccatgaactcactaaccctcccttccgaagtcaacctttgcaacgttgacatattcaacccaaagtacgattgcaaaattatgacatccaaaacagatgtctcctcctccgtcatcacatccctcggtgccattgtatcatgctacggaaaaaccaaatgcaccgcatccaacaaaaacaaaggaatcatcaaaaccttctcaaacggctgcgattacgtctcaaacaaaggagtcgacacagtctccgtcggaaacaccctatactacgtcaacaaacaagaaggccaatccctgtacgtcaaaggagaacccatcatcaacttctacgaccccctcgtcttcccgagcgacgagttcgacgcctccatctcacaagtcaatgaaaagatcaaccaatcccttgccttcatccggaaatcggacgaactcctacacaacgtgaacgctggaaaatcaaccaccaacatcatgatcacaaccatcattatcgtcatcatcgtcatactcctctccctaatcgccgtcggcctcctcctgtattgcaaagctcgctccacccccgtcaccctgtccaaagaccaactctccggaatcaacaacatcgccttctcaaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6289 - RNA, 1973 nt, synthetic construct
  misc_feature 1..1973: note = mRNA product Design f-2 comprising derived and/or modified sequence from HRSV(A2)__F_DSCav1_mut6 (opt1)
  source 1..1973: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaaccccgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6290 - RNA, 1973 nt, synthetic construct
  misc_feature 1..1973: note = mRNA product Design f-2 comprising derived and/or modified sequence from HRSV(A2)__F_DSCav1_mut6 (opt1)
  source 1..1973: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctcatgtgcagcacccccgccaccgggtccggcagcgccatcgcctccggcgtggcggtgtgcaaggtcctgcacctggagggggaggtgaacaagatcaagagcgccctcctgtccaccaacaaggccgtggtcagcctgtccaacggcgtgagcgtgctcacgttcaaggtcctggacctgaagaactacatcgacaagcagctcctgccgatcctgaacaagcagtcctgcagcatccccaaccccgagaccgtgatggagttccagcagaagaacaaccggctcctggagatcacccgcgagttctccgtgaacgccggggtcaccacgcccgtgagcacctacatgctgaccaactccgagctcctgagcctgatcaacgacatgccgatcaccaacgaccagaagaagctcatgagcaacaacgtgcagatcgtccggcagcagtcctacagcatcatgtgcatcatcaaggaggaggtgctggcctacgtggtccagctgcccctctacggcgtgatcgacacgccctgctggaagctgcacaccagccccctgtgcaccaccaacacgaaggaggggagcaacatctgcctcacccgcaccgaccggggctggtactgcgacaacgcgggctccgtgagcttcttcccgcaggccgagacctgcaaggtctgctccaaccgcgtgttctgcgacacgatgaacagcctgaccctgccctccgaggtcaacctctgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaacaaggggatcatcaagaccttctccaacggctgcgactacgtgagcaacaagggcgtcgacacggtgtccgtggggaacaccctgtactacgtcaacaagcaggagggccagagcctctacgtgaagggggagcccatcatcaacttctacgacccgctggtgttccccagcgacgagttcgacgcctccatcagccaggtcaacgagaagatcaaccagtccctggcgttcatccggaagtccgacgagctcctgcacaacgtgaacgccggcaagtccaccaccaacatcatgatcaccacgatcatcatcgtgatcatcgtcatcctgctcagcctgatcgccgtggggctgctcctgtactgcaaggcccgctccacccccgtgaccctgagcaaggaccagctgtccggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6291 - RNA, 1973 nt, synthetic construct
  misc_feature 1..1973: note = mRNA product Design f-2 comprising derived and/or modified sequence from HRSV(A2)__F_DSCav1_mut6 (opt2)
  source 1..1973: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6292 - RNA, 1973 nt, synthetic construct
  misc_feature 1..1973: note = mRNA product Design f-2 comprising derived and/or modified sequence from HRSV(A2)__F_DSCav1_mut6 (opt3)
  source 1..1973: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagatgcttatgtgttccacacccgccaccgggtctggatcggctatagcatcaggcgtggccgtctgcaaggtgctgcacttggagggtgaggttaacaaaatcaagagcgctctcctgagtacgaataaagccgtggtctccctgtctaacggggtgagcgtactcacttttaaggttttagatctgaagaattacattgacaaacagcttttgcctatcctgaacaagcaatcctgttcaattccaaatccggaaaccgtgatggagttccagcagaaaaacaataggctactcgaaatcacacgggagtttagtgtcaacgcgggagtgactacccccgtgagcacatatatgctgaccaattctgagcttctgtccttgataaacgatatgcctattacgaacgaccagaagaaactcatgtcaaataacgtccaaatcgttcgccagcagagctacagtattatgtgcatcatcaaggaagaggtgctggcatatgtagtgcagttaccactgtacggcgtcattgatactccctgttggaaactccatacatctcctctttgcaccactaatacaaaggaaggctccaacatatgtctgacccgaacggaccgtgggtggtactgcgataatgccggaagcgtgtcgttctttccacaagctgagacctgtaaggtttgctctaacagagtgttctgcgacacaatgaactccttgactctaccctcagaagtcaatctgtgtaatgtggatatctttaaccctaaatatgactgcaagattatgaccagtaaaacagatgtaagctcctctgttatcactagcctcggtgccatagtgtcatgttacggcaagaccaaatgcacagcaagtaataagaacaaggggattatcaaaaccttctccaatggatgtgactatgtcagcaacaagggcgtggacactgtctctgtgggtaatacgctgtactatgttaacaaacaggaggggcagtcactttacgtgaagggagagccaatcattaacttttatgatccgctggtattccccagtgacgaatttgatgctagcatctcccaagtcaatgagaaaattaaccagtctttggccttcataaggaagtcggacgaactcctgcacaatgtgaacgcgggcaagagcacaaccaatatcatgattactaccatcatcattgttataatcgtgattttactgtccctaatcgccgtcggcctcctgctttactgcaaagcacggtcaacacctgtgaccttgagtaaggatcagctgtctgggattaacaatatcgctttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6293 - RNA, 1973 nt, synthetic construct
  misc_feature 1..1973: note = mRNA product Design f-2 comprising derived and/or modified sequence from HRSV(A2)__F_DSCav1_mut6 (opt4)
  source 1..1973: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6294 - RNA, 1973 nt, synthetic construct
  misc_feature 1..1973: note = mRNA product Design f-2 comprising derived and/or modified sequence from HRSV(A2)__F_DSCav1_mut6 (opt5)
  source 1..1973: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagatgctgatgtgtagcacccccgccacaggatccggctctgctattgccagcggggtcgcggtgtgcaaggttctgcacctcgagggagaggtgaacaaaatcaagtccgccctgcttagcaccaataaagctgtcgtgtctctgtccaacggcgttagcgtgctcacatttaaggtcctggatcttaagaattacattgacaaacagctgctccctatcctgaacaagcaatcttgttccattccgaatcccgaaaccgtgatggagttccagcagaaaaacaatcggctgctcgaaatcacgcgcgagtttagcgtgaacgccggcgtcacaacccctgtttctacatatatgctgaccaattccgagcttctgagcctcattaacgatatgcccatcaccaacgaccagaagaaactgatgtccaataacgtgcaaatcgtgagacagcagtcttacagcattatgtgcatcattaaggaagaggtccttgcttatgtggttcagctgcctctctacggggtgatcgatacaccctgttggaaactgcatacgtcccctctgtgcaccacaaataccaaggaaggaagcaacatttgtctcacacggaccgaccgcggctggtactgcgataatgccgggtctgtctccttctttccgcaagcggagacgtgtaaggtgtgcagcaacagagttttctgcgacacaatgaactctctgacccttcccagcgaagtgaatctgtgtaatgtcgatatctttaaccctaaatatgactgcaagatcatgacctccaaaacagatgtgtctagctccgtcattaccagcctcggagccatcgtgtcttgttacggcaagacaaaatgcacggcttccaataagaacaaggggattatcaaaaccttcagcaatggatgtgactatgtttctaacaagggcgtggacacagtctccgtgggcaataccctgtactatgttaacaaacaggaggggcagagcctttacgtgaagggagagcccattatcaacttttatgatcctctggtcttcccctccgacgaatttgatgcctctatcagccaagtgaatgagaaaattaaccagtccctcgctttcatccggaagtctgacgaactgctgcacaatgtgaacgccggcaagagcacaaccaatattatgatcacgaccattatcattgttatcatcgtcattctcctgtcccttatcgccgtggggctgctcctgtactgcaaagctcgcagcacaccggtgaccctgtctaaggatcagctttccggaattaacaatatcgcgttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6295 - RNA, 1973 nt, synthetic construct
  misc_feature 1..1973: note = mRNA product Design f-2 comprising derived and/or modified sequence from HRSV(A2)__F_DSCav1_mut6 (opt6)
  source 1..1973: mol_type = other RNA
gggagagcggctcggccattttgtcccagtcagtccggaggctgcggctgcagaagtaccgcctgcggagtaactgcaaagaagcttaccatggaactattaatcttaaaagcaaatgctataaccacaatattaacagcagtaacattctgttttgcctccggacaaaacataacagaagaattttatcaatcaacatgctctgcagtatccaaaggttacttaggcgcactacgcactggatggtatacatcagtaataacaatagaactatcaaacataaaagaaaataaatgtaacggtactgacgcaaaagtgaaactaattaaacaagaactcgacaaatacaaaaatgctgtaacagacctacaaatgctaatgtgctcaacacccgcaaccggatcaggatcagccatagcctccggagtcgcagtatgcaaagtattacatcttgaaggagaagtaaataaaataaaatcagcattactatccacaaataaagccgtagtatcactatcaaacggtgtatccgtccttacattcaaagtattagatctaaaaaactacatagataaacaactactacccatcttaaacaaacaatcatgctcaattcccaacccagaaacagtcatggaatttcaacaaaaaaacaacagactcttagaaataacacgagaattttcagtaaacgcaggagtaaccacaccagtaagtacatacatgctcaccaactcagaattattatcacttattaacgacatgccaattacaaacgaccaaaaaaaattaatgtcaaacaatgtccaaattgttagacaacaatcatactctataatgtgtataataaaagaagaagtactagcttacgtagttcaattaccactatatggcgtaatagatacaccttgctggaaactacatacatctccattatgtacaactaacacaaaagaaggatctaacatatgcctaacacgcacagatcgaggatggtactgcgataatgcaggttccgtatcattctttccacaagcagaaacatgtaaagtatgctcaaacagagtattctgtgacactatgaactccttaaccctaccctcagaagtcaatctatgcaacgttgacatatttaacccaaaatacgactgtaaaatcatgacatctaaaacagacgtatcatcatcagttattacatccctaggagcaatagtatcttgctacggaaaaacaaaatgtacagcatccaacaaaaacaaaggaataatcaaaacattctcaaacggctgcgactacgtatcaaacaaaggtgtagacacagtatcagtaggaaatactttatattacgtaaataaacaagaaggacaatctctatacgttaaaggcgaacctattataaacttctacgacccactcgtattcccttcagacgaatttgacgcatctatatcccaagttaacgaaaaaatcaaccaatcattagcctttataagaaaatccgacgaattattacataacgtcaacgctggaaaatcaacaactaacataatgataaccacaataataatagtcatcatagttatattactaagtctaatagccgtaggcctcctactttattgcaaagcaagatcaacaccagtaacattatccaaagaccaactcagcggcataaacaatatagctttttcaaactagggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6296 - RNA, 1973 nt, synthetic construct
  misc_feature 1..1973: note = mRNA product Design f-2 comprising derived and/or modified sequence from HRSV(A2)__F_DSCav1_mut6 (opt11)
  source 1..1973: mol_type = other RNA
gggagagcggctcggccattttgtcccagtcagtccggaggctgcggctgcagaagtaccgcctgcggagtaactgcaaagaagcttaccatggaactcctcatcctcaaagccaacgcaatcacaaccatactaactgcagttactttctgcttcgcatccggccaaaacatcaccgaagagttctaccaatcaacctgctccgcagtctccaaaggatacctcggagcccttcgcaccggctggtacacctccgtcataaccatcgaactctcaaacataaaagaaaacaaatgcaacggcacagacgcgaaagtcaaacttatcaaacaagaactcgacaaatacaaaaacgccgtcaccgacctgcagatgctcatgtgctcaacccccgccacaggaagcggctctgctatcgcttccggcgtcgccgtctgcaaagtcctccacctcgaaggcgaagtaaacaaaatcaagtcagccctcctctccaccaacaaagccgtcgtctctctctcaaacggcgtatccgtcctcacattcaaagtcctcgacctcaaaaactacatcgacaaacaacttctccccatcctaaacaaacaatcatgctccatccccaaccccgaaacagtcatggaatttcaacaaaagaacaaccgcctcttagaaatcacccgagaattttccgtcaacgcgggagtcacaacccccgtttctacgtatatgctcaccaactccgaactcctttccctcataaacgacatgccaatcaccaacgaccaaaagaaactcatgtcaaacaacgtccaaatcgtccgacaacaatcctactctattatgtgcatcatcaaagaagaagttctcgcctacgtcgtccaactacccctctacggcgtgatcgacaccccctgctggaaactacacacctcacccctctgcaccaccaacaccaaggaaggctccaacatctgcctcacccgcaccgaccgcggctggtactgcgacaacgctggctccgtctcattcttcccgcaagccgaaacttgcaaagtatgctccaacagagtattctgcgacaccatgaactcactaaccctcccttccgaagtcaacctttgcaacgttgacatattcaacccaaagtacgattgcaaaattatgacatccaaaacagatgtctcctcctccgtcatcacatccctcggtgccattgtatcatgctacggaaaaaccaaatgcaccgcatccaacaaaaacaaaggaatcatcaaaaccttctcaaacggctgcgattacgtctcaaacaaaggagtcgacacagtctccgtcggaaacaccctatactacgtcaacaaacaagaaggccaatccctgtacgtcaaaggagaacccatcatcaacttctacgaccccctcgtcttcccgagcgacgagttcgacgcctccatctcacaagtcaatgaaaagatcaaccaatcccttgccttcatccggaaatcggacgaactcctacacaacgtgaacgctggaaaatcaaccaccaacatcatgatcacaaccatcattatcgtcatcatcgtcatactcctctccctaatcgccgtcggcctcctcctgtattgcaaagctcgctccacccccgtcaccctgtccaaagaccaactctccggaatcaacaacatcgccttctcaaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6297 - RNA, 1964 nt, synthetic construct
  misc_feature 1..1964: note = mRNA product Design f-3 comprising derived and/or modified sequence from HRSV(A2)__F_DSCav1_mut6 (opt1)
  source 1..1964: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaaccccgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6298 - RNA, 1964 nt, synthetic construct
  misc_feature 1..1964: note = mRNA product Design f-3 comprising derived and/or modified sequence from HRSV(A2)__F_DSCav1_mut6 (opt1)
  source 1..1964: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctcatgtgcagcacccccgccaccgggtccggcagcgccatcgcctccggcgtggcggtgtgcaaggtcctgcacctggagggggaggtgaacaagatcaagagcgccctcctgtccaccaacaaggccgtggtcagcctgtccaacggcgtgagcgtgctcacgttcaaggtcctggacctgaagaactacatcgacaagcagctcctgccgatcctgaacaagcagtcctgcagcatccccaaccccgagaccgtgatggagttccagcagaagaacaaccggctcctggagatcacccgcgagttctccgtgaacgccggggtcaccacgcccgtgagcacctacatgctgaccaactccgagctcctgagcctgatcaacgacatgccgatcaccaacgaccagaagaagctcatgagcaacaacgtgcagatcgtccggcagcagtcctacagcatcatgtgcatcatcaaggaggaggtgctggcctacgtggtccagctgcccctctacggcgtgatcgacacgccctgctggaagctgcacaccagccccctgtgcaccaccaacacgaaggaggggagcaacatctgcctcacccgcaccgaccggggctggtactgcgacaacgcgggctccgtgagcttcttcccgcaggccgagacctgcaaggtctgctccaaccgcgtgttctgcgacacgatgaacagcctgaccctgccctccgaggtcaacctctgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaacaaggggatcatcaagaccttctccaacggctgcgactacgtgagcaacaagggcgtcgacacggtgtccgtggggaacaccctgtactacgtcaacaagcaggagggccagagcctctacgtgaagggggagcccatcatcaacttctacgacccgctggtgttccccagcgacgagttcgacgcctccatcagccaggtcaacgagaagatcaaccagtccctggcgttcatccggaagtccgacgagctcctgcacaacgtgaacgccggcaagtccaccaccaacatcatgatcaccacgatcatcatcgtgatcatcgtcatcctgctcagcctgatcgccgtggggctgctcctgtactgcaaggcccgctccacccccgtgaccctgagcaaggaccagctgtccggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6299 - RNA, 1964 nt, synthetic construct
  misc_feature 1..1964: note = mRNA product Design f-3 comprising derived and/or modified sequence from HRSV(A2)__F_DSCav1_mut6 (opt2)
  source 1..1964: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6300 - RNA, 1964 nt, synthetic construct
  misc_feature 1..1964: note = mRNA product Design f-3 comprising derived and/or modified sequence from HRSV(A2)__F_DSCav1_mut6 (opt3)
  source 1..1964: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagatgcttatgtgttccacacccgccaccgggtctggatcggctatagcatcaggcgtggccgtctgcaaggtgctgcacttggagggtgaggttaacaaaatcaagagcgctctcctgagtacgaataaagccgtggtctccctgtctaacggggtgagcgtactcacttttaaggttttagatctgaagaattacattgacaaacagcttttgcctatcctgaacaagcaatcctgttcaattccaaatccggaaaccgtgatggagttccagcagaaaaacaataggctactcgaaatcacacgggagtttagtgtcaacgcgggagtgactacccccgtgagcacatatatgctgaccaattctgagcttctgtccttgataaacgatatgcctattacgaacgaccagaagaaactcatgtcaaataacgtccaaatcgttcgccagcagagctacagtattatgtgcatcatcaaggaagaggtgctggcatatgtagtgcagttaccactgtacggcgtcattgatactccctgttggaaactccatacatctcctctttgcaccactaatacaaaggaaggctccaacatatgtctgacccgaacggaccgtgggtggtactgcgataatgccggaagcgtgtcgttctttccacaagctgagacctgtaaggtttgctctaacagagtgttctgcgacacaatgaactccttgactctaccctcagaagtcaatctgtgtaatgtggatatctttaaccctaaatatgactgcaagattatgaccagtaaaacagatgtaagctcctctgttatcactagcctcggtgccatagtgtcatgttacggcaagaccaaatgcacagcaagtaataagaacaaggggattatcaaaaccttctccaatggatgtgactatgtcagcaacaagggcgtggacactgtctctgtgggtaatacgctgtactatgttaacaaacaggaggggcagtcactttacgtgaagggagagccaatcattaacttttatgatccgctggtattccccagtgacgaatttgatgctagcatctcccaagtcaatgagaaaattaaccagtctttggccttcataaggaagtcggacgaactcctgcacaatgtgaacgcgggcaagagcacaaccaatatcatgattactaccatcatcattgttataatcgtgattttactgtccctaatcgccgtcggcctcctgctttactgcaaagcacggtcaacacctgtgaccttgagtaaggatcagctgtctgggattaacaatatcgctttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6301 - RNA, 1964 nt, synthetic construct
  misc_feature 1..1964: note = mRNA product Design f-3 comprising derived and/or modified sequence from HRSV(A2)__F_DSCav1_mut6 (opt4)
  source 1..1964: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6302 - RNA, 1964 nt, synthetic construct
  misc_feature 1..1964: note = mRNA product Design f-3 comprising derived and/or modified sequence from HRSV(A2)__F_DSCav1_mut6 (opt5)
  source 1..1964: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagatgctgatgtgtagcacccccgccacaggatccggctctgctattgccagcggggtcgcggtgtgcaaggttctgcacctcgagggagaggtgaacaaaatcaagtccgccctgcttagcaccaataaagctgtcgtgtctctgtccaacggcgttagcgtgctcacatttaaggtcctggatcttaagaattacattgacaaacagctgctccctatcctgaacaagcaatcttgttccattccgaatcccgaaaccgtgatggagttccagcagaaaaacaatcggctgctcgaaatcacgcgcgagtttagcgtgaacgccggcgtcacaacccctgtttctacatatatgctgaccaattccgagcttctgagcctcattaacgatatgcccatcaccaacgaccagaagaaactgatgtccaataacgtgcaaatcgtgagacagcagtcttacagcattatgtgcatcattaaggaagaggtccttgcttatgtggttcagctgcctctctacggggtgatcgatacaccctgttggaaactgcatacgtcccctctgtgcaccacaaataccaaggaaggaagcaacatttgtctcacacggaccgaccgcggctggtactgcgataatgccgggtctgtctccttctttccgcaagcggagacgtgtaaggtgtgcagcaacagagttttctgcgacacaatgaactctctgacccttcccagcgaagtgaatctgtgtaatgtcgatatctttaaccctaaatatgactgcaagatcatgacctccaaaacagatgtgtctagctccgtcattaccagcctcggagccatcgtgtcttgttacggcaagacaaaatgcacggcttccaataagaacaaggggattatcaaaaccttcagcaatggatgtgactatgtttctaacaagggcgtggacacagtctccgtgggcaataccctgtactatgttaacaaacaggaggggcagagcctttacgtgaagggagagcccattatcaacttttatgatcctctggtcttcccctccgacgaatttgatgcctctatcagccaagtgaatgagaaaattaaccagtccctcgctttcatccggaagtctgacgaactgctgcacaatgtgaacgccggcaagagcacaaccaatattatgatcacgaccattatcattgttatcatcgtcattctcctgtcccttatcgccgtggggctgctcctgtactgcaaagctcgcagcacaccggtgaccctgtctaaggatcagctttccggaattaacaatatcgcgttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6303 - RNA, 1964 nt, synthetic construct
  misc_feature 1..1964: note = mRNA product Design f-3 comprising derived and/or modified sequence from HRSV(A2)__F_DSCav1_mut6 (opt6)
  source 1..1964: mol_type = other RNA
gggagagtcccgcagtcggcgtccagcggctctgcttgttcgtgtgtgtgtcgttgcaggccttattcaagcttaccatggaactattaatcttaaaagcaaatgctataaccacaatattaacagcagtaacattctgttttgcctccggacaaaacataacagaagaattttatcaatcaacatgctctgcagtatccaaaggttacttaggcgcactacgcactggatggtatacatcagtaataacaatagaactatcaaacataaaagaaaataaatgtaacggtactgacgcaaaagtgaaactaattaaacaagaactcgacaaatacaaaaatgctgtaacagacctacaaatgctaatgtgctcaacacccgcaaccggatcaggatcagccatagcctccggagtcgcagtatgcaaagtattacatcttgaaggagaagtaaataaaataaaatcagcattactatccacaaataaagccgtagtatcactatcaaacggtgtatccgtccttacattcaaagtattagatctaaaaaactacatagataaacaactactacccatcttaaacaaacaatcatgctcaattcccaacccagaaacagtcatggaatttcaacaaaaaaacaacagactcttagaaataacacgagaattttcagtaaacgcaggagtaaccacaccagtaagtacatacatgctcaccaactcagaattattatcacttattaacgacatgccaattacaaacgaccaaaaaaaattaatgtcaaacaatgtccaaattgttagacaacaatcatactctataatgtgtataataaaagaagaagtactagcttacgtagttcaattaccactatatggcgtaatagatacaccttgctggaaactacatacatctccattatgtacaactaacacaaaagaaggatctaacatatgcctaacacgcacagatcgaggatggtactgcgataatgcaggttccgtatcattctttccacaagcagaaacatgtaaagtatgctcaaacagagtattctgtgacactatgaactccttaaccctaccctcagaagtcaatctatgcaacgttgacatatttaacccaaaatacgactgtaaaatcatgacatctaaaacagacgtatcatcatcagttattacatccctaggagcaatagtatcttgctacggaaaaacaaaatgtacagcatccaacaaaaacaaaggaataatcaaaacattctcaaacggctgcgactacgtatcaaacaaaggtgtagacacagtatcagtaggaaatactttatattacgtaaataaacaagaaggacaatctctatacgttaaaggcgaacctattataaacttctacgacccactcgtattcccttcagacgaatttgacgcatctatatcccaagttaacgaaaaaatcaaccaatcattagcctttataagaaaatccgacgaattattacataacgtcaacgctggaaaatcaacaactaacataatgataaccacaataataatagtcatcatagttatattactaagtctaatagccgtaggcctcctactttattgcaaagcaagatcaacaccagtaacattatccaaagaccaactcagcggcataaacaatatagctttttcaaactagggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6304 - RNA, 1964 nt, synthetic construct
  misc_feature 1..1964: note = mRNA product Design f-3 comprising derived and/or modified sequence from HRSV(A2)__F_DSCav1_mut6 (opt11)
  source 1..1964: mol_type = other RNA
gggagagtcccgcagtcggcgtccagcggctctgcttgttcgtgtgtgtgtcgttgcaggccttattcaagcttaccatggaactcctcatcctcaaagccaacgcaatcacaaccatactaactgcagttactttctgcttcgcatccggccaaaacatcaccgaagagttctaccaatcaacctgctccgcagtctccaaaggatacctcggagcccttcgcaccggctggtacacctccgtcataaccatcgaactctcaaacataaaagaaaacaaatgcaacggcacagacgcgaaagtcaaacttatcaaacaagaactcgacaaatacaaaaacgccgtcaccgacctgcagatgctcatgtgctcaacccccgccacaggaagcggctctgctatcgcttccggcgtcgccgtctgcaaagtcctccacctcgaaggcgaagtaaacaaaatcaagtcagccctcctctccaccaacaaagccgtcgtctctctctcaaacggcgtatccgtcctcacattcaaagtcctcgacctcaaaaactacatcgacaaacaacttctccccatcctaaacaaacaatcatgctccatccccaaccccgaaacagtcatggaatttcaacaaaagaacaaccgcctcttagaaatcacccgagaattttccgtcaacgcgggagtcacaacccccgtttctacgtatatgctcaccaactccgaactcctttccctcataaacgacatgccaatcaccaacgaccaaaagaaactcatgtcaaacaacgtccaaatcgtccgacaacaatcctactctattatgtgcatcatcaaagaagaagttctcgcctacgtcgtccaactacccctctacggcgtgatcgacaccccctgctggaaactacacacctcacccctctgcaccaccaacaccaaggaaggctccaacatctgcctcacccgcaccgaccgcggctggtactgcgacaacgctggctccgtctcattcttcccgcaagccgaaacttgcaaagtatgctccaacagagtattctgcgacaccatgaactcactaaccctcccttccgaagtcaacctttgcaacgttgacatattcaacccaaagtacgattgcaaaattatgacatccaaaacagatgtctcctcctccgtcatcacatccctcggtgccattgtatcatgctacggaaaaaccaaatgcaccgcatccaacaaaaacaaaggaatcatcaaaaccttctcaaacggctgcgattacgtctcaaacaaaggagtcgacacagtctccgtcggaaacaccctatactacgtcaacaaacaagaaggccaatccctgtacgtcaaaggagaacccatcatcaacttctacgaccccctcgtcttcccgagcgacgagttcgacgcctccatctcacaagtcaatgaaaagatcaaccaatcccttgccttcatccggaaatcggacgaactcctacacaacgtgaacgctggaaaatcaaccaccaacatcatgatcacaaccatcattatcgtcatcatcgtcatactcctctccctaatcgccgtcggcctcctcctgtattgcaaagctcgctccacccccgtcaccctgtccaaagaccaactctccggaatcaacaacatcgccttctcaaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6305 - RNA, 2180 nt, synthetic construct
  misc_feature 1..2180: note = mRNA product Design f-4 comprising derived and/or modified sequence from HRSV(A2)__F_DSCav1_mut6 (opt1)
  source 1..2180: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaaccccgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6306 - RNA, 2180 nt, synthetic construct
  misc_feature 1..2180: note = mRNA product Design f-4 comprising derived and/or modified sequence from HRSV(A2)__F_DSCav1_mut6 (opt1)
  source 1..2180: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctcatgtgcagcacccccgccaccgggtccggcagcgccatcgcctccggcgtggcggtgtgcaaggtcctgcacctggagggggaggtgaacaagatcaagagcgccctcctgtccaccaacaaggccgtggtcagcctgtccaacggcgtgagcgtgctcacgttcaaggtcctggacctgaagaactacatcgacaagcagctcctgccgatcctgaacaagcagtcctgcagcatccccaaccccgagaccgtgatggagttccagcagaagaacaaccggctcctggagatcacccgcgagttctccgtgaacgccggggtcaccacgcccgtgagcacctacatgctgaccaactccgagctcctgagcctgatcaacgacatgccgatcaccaacgaccagaagaagctcatgagcaacaacgtgcagatcgtccggcagcagtcctacagcatcatgtgcatcatcaaggaggaggtgctggcctacgtggtccagctgcccctctacggcgtgatcgacacgccctgctggaagctgcacaccagccccctgtgcaccaccaacacgaaggaggggagcaacatctgcctcacccgcaccgaccggggctggtactgcgacaacgcgggctccgtgagcttcttcccgcaggccgagacctgcaaggtctgctccaaccgcgtgttctgcgacacgatgaacagcctgaccctgccctccgaggtcaacctctgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaacaaggggatcatcaagaccttctccaacggctgcgactacgtgagcaacaagggcgtcgacacggtgtccgtggggaacaccctgtactacgtcaacaagcaggagggccagagcctctacgtgaagggggagcccatcatcaacttctacgacccgctggtgttccccagcgacgagttcgacgcctccatcagccaggtcaacgagaagatcaaccagtccctggcgttcatccggaagtccgacgagctcctgcacaacgtgaacgccggcaagtccaccaccaacatcatgatcaccacgatcatcatcgtgatcatcgtcatcctgctcagcctgatcgccgtggggctgctcctgtactgcaaggcccgctccacccccgtgaccctgagcaaggaccagctgtccggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6307 - RNA, 2180 nt, synthetic construct
  misc_feature 1..2180: note = mRNA product Design f-4 comprising derived and/or modified sequence from HRSV(A2)__F_DSCav1_mut6 (opt2)
  source 1..2180: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6308 - RNA, 2180 nt, synthetic construct
  misc_feature 1..2180: note = mRNA product Design f-4 comprising derived and/or modified sequence from HRSV(A2)__F_DSCav1_mut6 (opt3)
  source 1..2180: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagatgcttatgtgttccacacccgccaccgggtctggatcggctatagcatcaggcgtggccgtctgcaaggtgctgcacttggagggtgaggttaacaaaatcaagagcgctctcctgagtacgaataaagccgtggtctccctgtctaacggggtgagcgtactcacttttaaggttttagatctgaagaattacattgacaaacagcttttgcctatcctgaacaagcaatcctgttcaattccaaatccggaaaccgtgatggagttccagcagaaaaacaataggctactcgaaatcacacgggagtttagtgtcaacgcgggagtgactacccccgtgagcacatatatgctgaccaattctgagcttctgtccttgataaacgatatgcctattacgaacgaccagaagaaactcatgtcaaataacgtccaaatcgttcgccagcagagctacagtattatgtgcatcatcaaggaagaggtgctggcatatgtagtgcagttaccactgtacggcgtcattgatactccctgttggaaactccatacatctcctctttgcaccactaatacaaaggaaggctccaacatatgtctgacccgaacggaccgtgggtggtactgcgataatgccggaagcgtgtcgttctttccacaagctgagacctgtaaggtttgctctaacagagtgttctgcgacacaatgaactccttgactctaccctcagaagtcaatctgtgtaatgtggatatctttaaccctaaatatgactgcaagattatgaccagtaaaacagatgtaagctcctctgttatcactagcctcggtgccatagtgtcatgttacggcaagaccaaatgcacagcaagtaataagaacaaggggattatcaaaaccttctccaatggatgtgactatgtcagcaacaagggcgtggacactgtctctgtgggtaatacgctgtactatgttaacaaacaggaggggcagtcactttacgtgaagggagagccaatcattaacttttatgatccgctggtattccccagtgacgaatttgatgctagcatctcccaagtcaatgagaaaattaaccagtctttggccttcataaggaagtcggacgaactcctgcacaatgtgaacgcgggcaagagcacaaccaatatcatgattactaccatcatcattgttataatcgtgattttactgtccctaatcgccgtcggcctcctgctttactgcaaagcacggtcaacacctgtgaccttgagtaaggatcagctgtctgggattaacaatatcgctttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6309 - RNA, 2180 nt, synthetic construct
  misc_feature 1..2180: note = mRNA product Design f-4 comprising derived and/or modified sequence from HRSV(A2)__F_DSCav1_mut6 (opt4)
  source 1..2180: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6310 - RNA, 2180 nt, synthetic construct
  misc_feature 1..2180: note = mRNA product Design f-4 comprising derived and/or modified sequence from HRSV(A2)__F_DSCav1_mut6 (opt5)
  source 1..2180: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagatgctgatgtgtagcacccccgccacaggatccggctctgctattgccagcggggtcgcggtgtgcaaggttctgcacctcgagggagaggtgaacaaaatcaagtccgccctgcttagcaccaataaagctgtcgtgtctctgtccaacggcgttagcgtgctcacatttaaggtcctggatcttaagaattacattgacaaacagctgctccctatcctgaacaagcaatcttgttccattccgaatcccgaaaccgtgatggagttccagcagaaaaacaatcggctgctcgaaatcacgcgcgagtttagcgtgaacgccggcgtcacaacccctgtttctacatatatgctgaccaattccgagcttctgagcctcattaacgatatgcccatcaccaacgaccagaagaaactgatgtccaataacgtgcaaatcgtgagacagcagtcttacagcattatgtgcatcattaaggaagaggtccttgcttatgtggttcagctgcctctctacggggtgatcgatacaccctgttggaaactgcatacgtcccctctgtgcaccacaaataccaaggaaggaagcaacatttgtctcacacggaccgaccgcggctggtactgcgataatgccgggtctgtctccttctttccgcaagcggagacgtgtaaggtgtgcagcaacagagttttctgcgacacaatgaactctctgacccttcccagcgaagtgaatctgtgtaatgtcgatatctttaaccctaaatatgactgcaagatcatgacctccaaaacagatgtgtctagctccgtcattaccagcctcggagccatcgtgtcttgttacggcaagacaaaatgcacggcttccaataagaacaaggggattatcaaaaccttcagcaatggatgtgactatgtttctaacaagggcgtggacacagtctccgtgggcaataccctgtactatgttaacaaacaggaggggcagagcctttacgtgaagggagagcccattatcaacttttatgatcctctggtcttcccctccgacgaatttgatgcctctatcagccaagtgaatgagaaaattaaccagtccctcgctttcatccggaagtctgacgaactgctgcacaatgtgaacgccggcaagagcacaaccaatattatgatcacgaccattatcattgttatcatcgtcattctcctgtcccttatcgccgtggggctgctcctgtactgcaaagctcgcagcacaccggtgaccctgtctaaggatcagctttccggaattaacaatatcgcgttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6311 - RNA, 2180 nt, synthetic construct
  misc_feature 1..2180: note = mRNA product Design f-4 comprising derived and/or modified sequence from HRSV(A2)__F_DSCav1_mut6 (opt6)
  source 1..2180: mol_type = other RNA
gggagagtcccgcagtcggcgtccagcggctctgcttgttcgtgtgtgtgtcgttgcaggccttattcaagcttaccatggaactattaatcttaaaagcaaatgctataaccacaatattaacagcagtaacattctgttttgcctccggacaaaacataacagaagaattttatcaatcaacatgctctgcagtatccaaaggttacttaggcgcactacgcactggatggtatacatcagtaataacaatagaactatcaaacataaaagaaaataaatgtaacggtactgacgcaaaagtgaaactaattaaacaagaactcgacaaatacaaaaatgctgtaacagacctacaaatgctaatgtgctcaacacccgcaaccggatcaggatcagccatagcctccggagtcgcagtatgcaaagtattacatcttgaaggagaagtaaataaaataaaatcagcattactatccacaaataaagccgtagtatcactatcaaacggtgtatccgtccttacattcaaagtattagatctaaaaaactacatagataaacaactactacccatcttaaacaaacaatcatgctcaattcccaacccagaaacagtcatggaatttcaacaaaaaaacaacagactcttagaaataacacgagaattttcagtaaacgcaggagtaaccacaccagtaagtacatacatgctcaccaactcagaattattatcacttattaacgacatgccaattacaaacgaccaaaaaaaattaatgtcaaacaatgtccaaattgttagacaacaatcatactctataatgtgtataataaaagaagaagtactagcttacgtagttcaattaccactatatggcgtaatagatacaccttgctggaaactacatacatctccattatgtacaactaacacaaaagaaggatctaacatatgcctaacacgcacagatcgaggatggtactgcgataatgcaggttccgtatcattctttccacaagcagaaacatgtaaagtatgctcaaacagagtattctgtgacactatgaactccttaaccctaccctcagaagtcaatctatgcaacgttgacatatttaacccaaaatacgactgtaaaatcatgacatctaaaacagacgtatcatcatcagttattacatccctaggagcaatagtatcttgctacggaaaaacaaaatgtacagcatccaacaaaaacaaaggaataatcaaaacattctcaaacggctgcgactacgtatcaaacaaaggtgtagacacagtatcagtaggaaatactttatattacgtaaataaacaagaaggacaatctctatacgttaaaggcgaacctattataaacttctacgacccactcgtattcccttcagacgaatttgacgcatctatatcccaagttaacgaaaaaatcaaccaatcattagcctttataagaaaatccgacgaattattacataacgtcaacgctggaaaatcaacaactaacataatgataaccacaataataatagtcatcatagttatattactaagtctaatagccgtaggcctcctactttattgcaaagcaagatcaacaccagtaacattatccaaagaccaactcagcggcataaacaatatagctttttcaaactagggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6312 - RNA, 2180 nt, synthetic construct
  misc_feature 1..2180: note = mRNA product Design f-4 comprising derived and/or modified sequence from HRSV(A2)__F_DSCav1_mut6 (opt11)
  source 1..2180: mol_type = other RNA
gggagagtcccgcagtcggcgtccagcggctctgcttgttcgtgtgtgtgtcgttgcaggccttattcaagcttaccatggaactcctcatcctcaaagccaacgcaatcacaaccatactaactgcagttactttctgcttcgcatccggccaaaacatcaccgaagagttctaccaatcaacctgctccgcagtctccaaaggatacctcggagcccttcgcaccggctggtacacctccgtcataaccatcgaactctcaaacataaaagaaaacaaatgcaacggcacagacgcgaaagtcaaacttatcaaacaagaactcgacaaatacaaaaacgccgtcaccgacctgcagatgctcatgtgctcaacccccgccacaggaagcggctctgctatcgcttccggcgtcgccgtctgcaaagtcctccacctcgaaggcgaagtaaacaaaatcaagtcagccctcctctccaccaacaaagccgtcgtctctctctcaaacggcgtatccgtcctcacattcaaagtcctcgacctcaaaaactacatcgacaaacaacttctccccatcctaaacaaacaatcatgctccatccccaaccccgaaacagtcatggaatttcaacaaaagaacaaccgcctcttagaaatcacccgagaattttccgtcaacgcgggagtcacaacccccgtttctacgtatatgctcaccaactccgaactcctttccctcataaacgacatgccaatcaccaacgaccaaaagaaactcatgtcaaacaacgtccaaatcgtccgacaacaatcctactctattatgtgcatcatcaaagaagaagttctcgcctacgtcgtccaactacccctctacggcgtgatcgacaccccctgctggaaactacacacctcacccctctgcaccaccaacaccaaggaaggctccaacatctgcctcacccgcaccgaccgcggctggtactgcgacaacgctggctccgtctcattcttcccgcaagccgaaacttgcaaagtatgctccaacagagtattctgcgacaccatgaactcactaaccctcccttccgaagtcaacctttgcaacgttgacatattcaacccaaagtacgattgcaaaattatgacatccaaaacagatgtctcctcctccgtcatcacatccctcggtgccattgtatcatgctacggaaaaaccaaatgcaccgcatccaacaaaaacaaaggaatcatcaaaaccttctcaaacggctgcgattacgtctcaaacaaaggagtcgacacagtctccgtcggaaacaccctatactacgtcaacaaacaagaaggccaatccctgtacgtcaaaggagaacccatcatcaacttctacgaccccctcgtcttcccgagcgacgagttcgacgcctccatctcacaagtcaatgaaaagatcaaccaatcccttgccttcatccggaaatcggacgaactcctacacaacgtgaacgctggaaaatcaaccaccaacatcatgatcacaaccatcattatcgtcatcatcgtcatactcctctccctaatcgccgtcggcctcctcctgtattgcaaagctcgctccacccccgtcaccctgtccaaagaccaactctccggaatcaacaacatcgccttctcaaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6313 - RNA, 1956 nt, synthetic construct
  misc_feature 1..1956: note = mRNA product Design f-5 comprising derived and/or modified sequence from HRSV(A2)__F_DSCav1_mut6 (opt1)
  source 1..1956: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaaccccgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6314 - RNA, 1956 nt, synthetic construct
  misc_feature 1..1956: note = mRNA product Design f-5 comprising derived and/or modified sequence from HRSV(A2)__F_DSCav1_mut6 (opt1)
  source 1..1956: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctcatgtgcagcacccccgccaccgggtccggcagcgccatcgcctccggcgtggcggtgtgcaaggtcctgcacctggagggggaggtgaacaagatcaagagcgccctcctgtccaccaacaaggccgtggtcagcctgtccaacggcgtgagcgtgctcacgttcaaggtcctggacctgaagaactacatcgacaagcagctcctgccgatcctgaacaagcagtcctgcagcatccccaaccccgagaccgtgatggagttccagcagaagaacaaccggctcctggagatcacccgcgagttctccgtgaacgccggggtcaccacgcccgtgagcacctacatgctgaccaactccgagctcctgagcctgatcaacgacatgccgatcaccaacgaccagaagaagctcatgagcaacaacgtgcagatcgtccggcagcagtcctacagcatcatgtgcatcatcaaggaggaggtgctggcctacgtggtccagctgcccctctacggcgtgatcgacacgccctgctggaagctgcacaccagccccctgtgcaccaccaacacgaaggaggggagcaacatctgcctcacccgcaccgaccggggctggtactgcgacaacgcgggctccgtgagcttcttcccgcaggccgagacctgcaaggtctgctccaaccgcgtgttctgcgacacgatgaacagcctgaccctgccctccgaggtcaacctctgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaacaaggggatcatcaagaccttctccaacggctgcgactacgtgagcaacaagggcgtcgacacggtgtccgtggggaacaccctgtactacgtcaacaagcaggagggccagagcctctacgtgaagggggagcccatcatcaacttctacgacccgctggtgttccccagcgacgagttcgacgcctccatcagccaggtcaacgagaagatcaaccagtccctggcgttcatccggaagtccgacgagctcctgcacaacgtgaacgccggcaagtccaccaccaacatcatgatcaccacgatcatcatcgtgatcatcgtcatcctgctcagcctgatcgccgtggggctgctcctgtactgcaaggcccgctccacccccgtgaccctgagcaaggaccagctgtccggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6315 - RNA, 1956 nt, synthetic construct
  misc_feature 1..1956: note = mRNA product Design f-5 comprising derived and/or modified sequence from HRSV(A2)__F_DSCav1_mut6 (opt2)
  source 1..1956: mol_type = other RNA
gggagactttcccattctgtagcagaatttggtgttgcctgtggtcttggtcccgcggagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6316 - RNA, 1956 nt, synthetic construct
  misc_feature 1..1956: note = mRNA product Design f-5 comprising derived and/or modified sequence from HRSV(A2)__F_DSCav1_mut6 (opt3)
  source 1..1956: mol_type = other RNA
gggagactttcccattctgtagcagaatttggtgttgcctgtggtcttggtcccgcggagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagatgcttatgtgttccacacccgccaccgggtctggatcggctatagcatcaggcgtggccgtctgcaaggtgctgcacttggagggtgaggttaacaaaatcaagagcgctctcctgagtacgaataaagccgtggtctccctgtctaacggggtgagcgtactcacttttaaggttttagatctgaagaattacattgacaaacagcttttgcctatcctgaacaagcaatcctgttcaattccaaatccggaaaccgtgatggagttccagcagaaaaacaataggctactcgaaatcacacgggagtttagtgtcaacgcgggagtgactacccccgtgagcacatatatgctgaccaattctgagcttctgtccttgataaacgatatgcctattacgaacgaccagaagaaactcatgtcaaataacgtccaaatcgttcgccagcagagctacagtattatgtgcatcatcaaggaagaggtgctggcatatgtagtgcagttaccactgtacggcgtcattgatactccctgttggaaactccatacatctcctctttgcaccactaatacaaaggaaggctccaacatatgtctgacccgaacggaccgtgggtggtactgcgataatgccggaagcgtgtcgttctttccacaagctgagacctgtaaggtttgctctaacagagtgttctgcgacacaatgaactccttgactctaccctcagaagtcaatctgtgtaatgtggatatctttaaccctaaatatgactgcaagattatgaccagtaaaacagatgtaagctcctctgttatcactagcctcggtgccatagtgtcatgttacggcaagaccaaatgcacagcaagtaataagaacaaggggattatcaaaaccttctccaatggatgtgactatgtcagcaacaagggcgtggacactgtctctgtgggtaatacgctgtactatgttaacaaacaggaggggcagtcactttacgtgaagggagagccaatcattaacttttatgatccgctggtattccccagtgacgaatttgatgctagcatctcccaagtcaatgagaaaattaaccagtctttggccttcataaggaagtcggacgaactcctgcacaatgtgaacgcgggcaagagcacaaccaatatcatgattactaccatcatcattgttataatcgtgattttactgtccctaatcgccgtcggcctcctgctttactgcaaagcacggtcaacacctgtgaccttgagtaaggatcagctgtctgggattaacaatatcgctttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6317 - RNA, 1956 nt, synthetic construct
  misc_feature 1..1956: note = mRNA product Design f-5 comprising derived and/or modified sequence from HRSV(A2)__F_DSCav1_mut6 (opt4)
  source 1..1956: mol_type = other RNA
gggagactttcccattctgtagcagaatttggtgttgcctgtggtcttggtcccgcggagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6318 - RNA, 1956 nt, synthetic construct
  misc_feature 1..1956: note = mRNA product Design f-5 comprising derived and/or modified sequence from HRSV(A2)__F_DSCav1_mut6 (opt5)
  source 1..1956: mol_type = other RNA
gggagactttcccattctgtagcagaatttggtgttgcctgtggtcttggtcccgcggagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagatgctgatgtgtagcacccccgccacaggatccggctctgctattgccagcggggtcgcggtgtgcaaggttctgcacctcgagggagaggtgaacaaaatcaagtccgccctgcttagcaccaataaagctgtcgtgtctctgtccaacggcgttagcgtgctcacatttaaggtcctggatcttaagaattacattgacaaacagctgctccctatcctgaacaagcaatcttgttccattccgaatcccgaaaccgtgatggagttccagcagaaaaacaatcggctgctcgaaatcacgcgcgagtttagcgtgaacgccggcgtcacaacccctgtttctacatatatgctgaccaattccgagcttctgagcctcattaacgatatgcccatcaccaacgaccagaagaaactgatgtccaataacgtgcaaatcgtgagacagcagtcttacagcattatgtgcatcattaaggaagaggtccttgcttatgtggttcagctgcctctctacggggtgatcgatacaccctgttggaaactgcatacgtcccctctgtgcaccacaaataccaaggaaggaagcaacatttgtctcacacggaccgaccgcggctggtactgcgataatgccgggtctgtctccttctttccgcaagcggagacgtgtaaggtgtgcagcaacagagttttctgcgacacaatgaactctctgacccttcccagcgaagtgaatctgtgtaatgtcgatatctttaaccctaaatatgactgcaagatcatgacctccaaaacagatgtgtctagctccgtcattaccagcctcggagccatcgtgtcttgttacggcaagacaaaatgcacggcttccaataagaacaaggggattatcaaaaccttcagcaatggatgtgactatgtttctaacaagggcgtggacacagtctccgtgggcaataccctgtactatgttaacaaacaggaggggcagagcctttacgtgaagggagagcccattatcaacttttatgatcctctggtcttcccctccgacgaatttgatgcctctatcagccaagtgaatgagaaaattaaccagtccctcgctttcatccggaagtctgacgaactgctgcacaatgtgaacgccggcaagagcacaaccaatattatgatcacgaccattatcattgttatcatcgtcattctcctgtcccttatcgccgtggggctgctcctgtactgcaaagctcgcagcacaccggtgaccctgtctaaggatcagctttccggaattaacaatatcgcgttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6319 - RNA, 1956 nt, synthetic construct
  misc_feature 1..1956: note = mRNA product Design f-5 comprising derived and/or modified sequence from HRSV(A2)__F_DSCav1_mut6 (opt6)
  source 1..1956: mol_type = other RNA
gggagactttcccattctgtagcagaatttggtgttgcctgtggtcttggtcccgcggagaagcttaccatggaactattaatcttaaaagcaaatgctataaccacaatattaacagcagtaacattctgttttgcctccggacaaaacataacagaagaattttatcaatcaacatgctctgcagtatccaaaggttacttaggcgcactacgcactggatggtatacatcagtaataacaatagaactatcaaacataaaagaaaataaatgtaacggtactgacgcaaaagtgaaactaattaaacaagaactcgacaaatacaaaaatgctgtaacagacctacaaatgctaatgtgctcaacacccgcaaccggatcaggatcagccatagcctccggagtcgcagtatgcaaagtattacatcttgaaggagaagtaaataaaataaaatcagcattactatccacaaataaagccgtagtatcactatcaaacggtgtatccgtccttacattcaaagtattagatctaaaaaactacatagataaacaactactacccatcttaaacaaacaatcatgctcaattcccaacccagaaacagtcatggaatttcaacaaaaaaacaacagactcttagaaataacacgagaattttcagtaaacgcaggagtaaccacaccagtaagtacatacatgctcaccaactcagaattattatcacttattaacgacatgccaattacaaacgaccaaaaaaaattaatgtcaaacaatgtccaaattgttagacaacaatcatactctataatgtgtataataaaagaagaagtactagcttacgtagttcaattaccactatatggcgtaatagatacaccttgctggaaactacatacatctccattatgtacaactaacacaaaagaaggatctaacatatgcctaacacgcacagatcgaggatggtactgcgataatgcaggttccgtatcattctttccacaagcagaaacatgtaaagtatgctcaaacagagtattctgtgacactatgaactccttaaccctaccctcagaagtcaatctatgcaacgttgacatatttaacccaaaatacgactgtaaaatcatgacatctaaaacagacgtatcatcatcagttattacatccctaggagcaatagtatcttgctacggaaaaacaaaatgtacagcatccaacaaaaacaaaggaataatcaaaacattctcaaacggctgcgactacgtatcaaacaaaggtgtagacacagtatcagtaggaaatactttatattacgtaaataaacaagaaggacaatctctatacgttaaaggcgaacctattataaacttctacgacccactcgtattcccttcagacgaatttgacgcatctatatcccaagttaacgaaaaaatcaaccaatcattagcctttataagaaaatccgacgaattattacataacgtcaacgctggaaaatcaacaactaacataatgataaccacaataataatagtcatcatagttatattactaagtctaatagccgtaggcctcctactttattgcaaagcaagatcaacaccagtaacattatccaaagaccaactcagcggcataaacaatatagctttttcaaactagggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6320 - RNA, 1956 nt, synthetic construct
  misc_feature 1..1956: note = mRNA product Design f-5 comprising derived and/or modified sequence from HRSV(A2)__F_DSCav1_mut6 (opt11)
  source 1..1956: mol_type = other RNA
gggagactttcccattctgtagcagaatttggtgttgcctgtggtcttggtcccgcggagaagcttaccatggaactcctcatcctcaaagccaacgcaatcacaaccatactaactgcagttactttctgcttcgcatccggccaaaacatcaccgaagagttctaccaatcaacctgctccgcagtctccaaaggatacctcggagcccttcgcaccggctggtacacctccgtcataaccatcgaactctcaaacataaaagaaaacaaatgcaacggcacagacgcgaaagtcaaacttatcaaacaagaactcgacaaatacaaaaacgccgtcaccgacctgcagatgctcatgtgctcaacccccgccacaggaagcggctctgctatcgcttccggcgtcgccgtctgcaaagtcctccacctcgaaggcgaagtaaacaaaatcaagtcagccctcctctccaccaacaaagccgtcgtctctctctcaaacggcgtatccgtcctcacattcaaagtcctcgacctcaaaaactacatcgacaaacaacttctccccatcctaaacaaacaatcatgctccatccccaaccccgaaacagtcatggaatttcaacaaaagaacaaccgcctcttagaaatcacccgagaattttccgtcaacgcgggagtcacaacccccgtttctacgtatatgctcaccaactccgaactcctttccctcataaacgacatgccaatcaccaacgaccaaaagaaactcatgtcaaacaacgtccaaatcgtccgacaacaatcctactctattatgtgcatcatcaaagaagaagttctcgcctacgtcgtccaactacccctctacggcgtgatcgacaccccctgctggaaactacacacctcacccctctgcaccaccaacaccaaggaaggctccaacatctgcctcacccgcaccgaccgcggctggtactgcgacaacgctggctccgtctcattcttcccgcaagccgaaacttgcaaagtatgctccaacagagtattctgcgacaccatgaactcactaaccctcccttccgaagtcaacctttgcaacgttgacatattcaacccaaagtacgattgcaaaattatgacatccaaaacagatgtctcctcctccgtcatcacatccctcggtgccattgtatcatgctacggaaaaaccaaatgcaccgcatccaacaaaaacaaaggaatcatcaaaaccttctcaaacggctgcgattacgtctcaaacaaaggagtcgacacagtctccgtcggaaacaccctatactacgtcaacaaacaagaaggccaatccctgtacgtcaaaggagaacccatcatcaacttctacgaccccctcgtcttcccgagcgacgagttcgacgcctccatctcacaagtcaatgaaaagatcaaccaatcccttgccttcatccggaaatcggacgaactcctacacaacgtgaacgctggaaaatcaaccaccaacatcatgatcacaaccatcattatcgtcatcatcgtcatactcctctccctaatcgccgtcggcctcctcctgtattgcaaagctcgctccacccccgtcaccctgtccaaagaccaactctccggaatcaacaacatcgccttctcaaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6321 - RNA, 1952 nt, synthetic construct
  misc_feature 1..1952: note = mRNA product Design g-1 comprising derived and/or modified sequence from HRSV(A2)__F_DSCav1_mut6 (opt1)
  source 1..1952: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaaccccgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6322 - RNA, 1952 nt, synthetic construct
  misc_feature 1..1952: note = mRNA product Design g-1 comprising derived and/or modified sequence from HRSV(A2)__F_DSCav1_mut6 (opt1)
  source 1..1952: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctcatgtgcagcacccccgccaccgggtccggcagcgccatcgcctccggcgtggcggtgtgcaaggtcctgcacctggagggggaggtgaacaagatcaagagcgccctcctgtccaccaacaaggccgtggtcagcctgtccaacggcgtgagcgtgctcacgttcaaggtcctggacctgaagaactacatcgacaagcagctcctgccgatcctgaacaagcagtcctgcagcatccccaaccccgagaccgtgatggagttccagcagaagaacaaccggctcctggagatcacccgcgagttctccgtgaacgccggggtcaccacgcccgtgagcacctacatgctgaccaactccgagctcctgagcctgatcaacgacatgccgatcaccaacgaccagaagaagctcatgagcaacaacgtgcagatcgtccggcagcagtcctacagcatcatgtgcatcatcaaggaggaggtgctggcctacgtggtccagctgcccctctacggcgtgatcgacacgccctgctggaagctgcacaccagccccctgtgcaccaccaacacgaaggaggggagcaacatctgcctcacccgcaccgaccggggctggtactgcgacaacgcgggctccgtgagcttcttcccgcaggccgagacctgcaaggtctgctccaaccgcgtgttctgcgacacgatgaacagcctgaccctgccctccgaggtcaacctctgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaacaaggggatcatcaagaccttctccaacggctgcgactacgtgagcaacaagggcgtcgacacggtgtccgtggggaacaccctgtactacgtcaacaagcaggagggccagagcctctacgtgaagggggagcccatcatcaacttctacgacccgctggtgttccccagcgacgagttcgacgcctccatcagccaggtcaacgagaagatcaaccagtccctggcgttcatccggaagtccgacgagctcctgcacaacgtgaacgccggcaagtccaccaccaacatcatgatcaccacgatcatcatcgtgatcatcgtcatcctgctcagcctgatcgccgtggggctgctcctgtactgcaaggcccgctccacccccgtgaccctgagcaaggaccagctgtccggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6323 - RNA, 1952 nt, synthetic construct
  misc_feature 1..1952: note = mRNA product Design g-1 comprising derived and/or modified sequence from HRSV(A2)__F_DSCav1_mut6 (opt2)
  source 1..1952: mol_type = other RNA
gggagactttcccattctgtagcagaatttggtgttgcctgtggtcttggtcccgcggagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6324 - RNA, 1952 nt, synthetic construct
  misc_feature 1..1952: note = mRNA product Design g-1 comprising derived and/or modified sequence from HRSV(A2)__F_DSCav1_mut6 (opt3)
  source 1..1952: mol_type = other RNA
gggagactttcccattctgtagcagaatttggtgttgcctgtggtcttggtcccgcggagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagatgcttatgtgttccacacccgccaccgggtctggatcggctatagcatcaggcgtggccgtctgcaaggtgctgcacttggagggtgaggttaacaaaatcaagagcgctctcctgagtacgaataaagccgtggtctccctgtctaacggggtgagcgtactcacttttaaggttttagatctgaagaattacattgacaaacagcttttgcctatcctgaacaagcaatcctgttcaattccaaatccggaaaccgtgatggagttccagcagaaaaacaataggctactcgaaatcacacgggagtttagtgtcaacgcgggagtgactacccccgtgagcacatatatgctgaccaattctgagcttctgtccttgataaacgatatgcctattacgaacgaccagaagaaactcatgtcaaataacgtccaaatcgttcgccagcagagctacagtattatgtgcatcatcaaggaagaggtgctggcatatgtagtgcagttaccactgtacggcgtcattgatactccctgttggaaactccatacatctcctctttgcaccactaatacaaaggaaggctccaacatatgtctgacccgaacggaccgtgggtggtactgcgataatgccggaagcgtgtcgttctttccacaagctgagacctgtaaggtttgctctaacagagtgttctgcgacacaatgaactccttgactctaccctcagaagtcaatctgtgtaatgtggatatctttaaccctaaatatgactgcaagattatgaccagtaaaacagatgtaagctcctctgttatcactagcctcggtgccatagtgtcatgttacggcaagaccaaatgcacagcaagtaataagaacaaggggattatcaaaaccttctccaatggatgtgactatgtcagcaacaagggcgtggacactgtctctgtgggtaatacgctgtactatgttaacaaacaggaggggcagtcactttacgtgaagggagagccaatcattaacttttatgatccgctggtattccccagtgacgaatttgatgctagcatctcccaagtcaatgagaaaattaaccagtctttggccttcataaggaagtcggacgaactcctgcacaatgtgaacgcgggcaagagcacaaccaatatcatgattactaccatcatcattgttataatcgtgattttactgtccctaatcgccgtcggcctcctgctttactgcaaagcacggtcaacacctgtgaccttgagtaaggatcagctgtctgggattaacaatatcgctttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6325 - RNA, 1952 nt, synthetic construct
  misc_feature 1..1952: note = mRNA product Design g-1 comprising derived and/or modified sequence from HRSV(A2)__F_DSCav1_mut6 (opt4)
  source 1..1952: mol_type = other RNA
gggagactttcccattctgtagcagaatttggtgttgcctgtggtcttggtcccgcggagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6326 - RNA, 1952 nt, synthetic construct
  misc_feature 1..1952: note = mRNA product Design g-1 comprising derived and/or modified sequence from HRSV(A2)__F_DSCav1_mut6 (opt5)
  source 1..1952: mol_type = other RNA
gggagactttcccattctgtagcagaatttggtgttgcctgtggtcttggtcccgcggagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagatgctgatgtgtagcacccccgccacaggatccggctctgctattgccagcggggtcgcggtgtgcaaggttctgcacctcgagggagaggtgaacaaaatcaagtccgccctgcttagcaccaataaagctgtcgtgtctctgtccaacggcgttagcgtgctcacatttaaggtcctggatcttaagaattacattgacaaacagctgctccctatcctgaacaagcaatcttgttccattccgaatcccgaaaccgtgatggagttccagcagaaaaacaatcggctgctcgaaatcacgcgcgagtttagcgtgaacgccggcgtcacaacccctgtttctacatatatgctgaccaattccgagcttctgagcctcattaacgatatgcccatcaccaacgaccagaagaaactgatgtccaataacgtgcaaatcgtgagacagcagtcttacagcattatgtgcatcattaaggaagaggtccttgcttatgtggttcagctgcctctctacggggtgatcgatacaccctgttggaaactgcatacgtcccctctgtgcaccacaaataccaaggaaggaagcaacatttgtctcacacggaccgaccgcggctggtactgcgataatgccgggtctgtctccttctttccgcaagcggagacgtgtaaggtgtgcagcaacagagttttctgcgacacaatgaactctctgacccttcccagcgaagtgaatctgtgtaatgtcgatatctttaaccctaaatatgactgcaagatcatgacctccaaaacagatgtgtctagctccgtcattaccagcctcggagccatcgtgtcttgttacggcaagacaaaatgcacggcttccaataagaacaaggggattatcaaaaccttcagcaatggatgtgactatgtttctaacaagggcgtggacacagtctccgtgggcaataccctgtactatgttaacaaacaggaggggcagagcctttacgtgaagggagagcccattatcaacttttatgatcctctggtcttcccctccgacgaatttgatgcctctatcagccaagtgaatgagaaaattaaccagtccctcgctttcatccggaagtctgacgaactgctgcacaatgtgaacgccggcaagagcacaaccaatattatgatcacgaccattatcattgttatcatcgtcattctcctgtcccttatcgccgtggggctgctcctgtactgcaaagctcgcagcacaccggtgaccctgtctaaggatcagctttccggaattaacaatatcgcgttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6327 - RNA, 1952 nt, synthetic construct
  misc_feature 1..1952: note = mRNA product Design g-1 comprising derived and/or modified sequence from HRSV(A2)__F_DSCav1_mut6 (opt6)
  source 1..1952: mol_type = other RNA
gggagactttcccattctgtagcagaatttggtgttgcctgtggtcttggtcccgcggagaagcttaccatggaactattaatcttaaaagcaaatgctataaccacaatattaacagcagtaacattctgttttgcctccggacaaaacataacagaagaattttatcaatcaacatgctctgcagtatccaaaggttacttaggcgcactacgcactggatggtatacatcagtaataacaatagaactatcaaacataaaagaaaataaatgtaacggtactgacgcaaaagtgaaactaattaaacaagaactcgacaaatacaaaaatgctgtaacagacctacaaatgctaatgtgctcaacacccgcaaccggatcaggatcagccatagcctccggagtcgcagtatgcaaagtattacatcttgaaggagaagtaaataaaataaaatcagcattactatccacaaataaagccgtagtatcactatcaaacggtgtatccgtccttacattcaaagtattagatctaaaaaactacatagataaacaactactacccatcttaaacaaacaatcatgctcaattcccaacccagaaacagtcatggaatttcaacaaaaaaacaacagactcttagaaataacacgagaattttcagtaaacgcaggagtaaccacaccagtaagtacatacatgctcaccaactcagaattattatcacttattaacgacatgccaattacaaacgaccaaaaaaaattaatgtcaaacaatgtccaaattgttagacaacaatcatactctataatgtgtataataaaagaagaagtactagcttacgtagttcaattaccactatatggcgtaatagatacaccttgctggaaactacatacatctccattatgtacaactaacacaaaagaaggatctaacatatgcctaacacgcacagatcgaggatggtactgcgataatgcaggttccgtatcattctttccacaagcagaaacatgtaaagtatgctcaaacagagtattctgtgacactatgaactccttaaccctaccctcagaagtcaatctatgcaacgttgacatatttaacccaaaatacgactgtaaaatcatgacatctaaaacagacgtatcatcatcagttattacatccctaggagcaatagtatcttgctacggaaaaacaaaatgtacagcatccaacaaaaacaaaggaataatcaaaacattctcaaacggctgcgactacgtatcaaacaaaggtgtagacacagtatcagtaggaaatactttatattacgtaaataaacaagaaggacaatctctatacgttaaaggcgaacctattataaacttctacgacccactcgtattcccttcagacgaatttgacgcatctatatcccaagttaacgaaaaaatcaaccaatcattagcctttataagaaaatccgacgaattattacataacgtcaacgctggaaaatcaacaactaacataatgataaccacaataataatagtcatcatagttatattactaagtctaatagccgtaggcctcctactttattgcaaagcaagatcaacaccagtaacattatccaaagaccaactcagcggcataaacaatatagctttttcaaactagggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6328 - RNA, 1952 nt, synthetic construct
  misc_feature 1..1952: note = mRNA product Design g-1 comprising derived and/or modified sequence from HRSV(A2)__F_DSCav1_mut6 (opt11)
  source 1..1952: mol_type = other RNA
gggagactttcccattctgtagcagaatttggtgttgcctgtggtcttggtcccgcggagaagcttaccatggaactcctcatcctcaaagccaacgcaatcacaaccatactaactgcagttactttctgcttcgcatccggccaaaacatcaccgaagagttctaccaatcaacctgctccgcagtctccaaaggatacctcggagcccttcgcaccggctggtacacctccgtcataaccatcgaactctcaaacataaaagaaaacaaatgcaacggcacagacgcgaaagtcaaacttatcaaacaagaactcgacaaatacaaaaacgccgtcaccgacctgcagatgctcatgtgctcaacccccgccacaggaagcggctctgctatcgcttccggcgtcgccgtctgcaaagtcctccacctcgaaggcgaagtaaacaaaatcaagtcagccctcctctccaccaacaaagccgtcgtctctctctcaaacggcgtatccgtcctcacattcaaagtcctcgacctcaaaaactacatcgacaaacaacttctccccatcctaaacaaacaatcatgctccatccccaaccccgaaacagtcatggaatttcaacaaaagaacaaccgcctcttagaaatcacccgagaattttccgtcaacgcgggagtcacaacccccgtttctacgtatatgctcaccaactccgaactcctttccctcataaacgacatgccaatcaccaacgaccaaaagaaactcatgtcaaacaacgtccaaatcgtccgacaacaatcctactctattatgtgcatcatcaaagaagaagttctcgcctacgtcgtccaactacccctctacggcgtgatcgacaccccctgctggaaactacacacctcacccctctgcaccaccaacaccaaggaaggctccaacatctgcctcacccgcaccgaccgcggctggtactgcgacaacgctggctccgtctcattcttcccgcaagccgaaacttgcaaagtatgctccaacagagtattctgcgacaccatgaactcactaaccctcccttccgaagtcaacctttgcaacgttgacatattcaacccaaagtacgattgcaaaattatgacatccaaaacagatgtctcctcctccgtcatcacatccctcggtgccattgtatcatgctacggaaaaaccaaatgcaccgcatccaacaaaaacaaaggaatcatcaaaaccttctcaaacggctgcgattacgtctcaaacaaaggagtcgacacagtctccgtcggaaacaccctatactacgtcaacaaacaagaaggccaatccctgtacgtcaaaggagaacccatcatcaacttctacgaccccctcgtcttcccgagcgacgagttcgacgcctccatctcacaagtcaatgaaaagatcaaccaatcccttgccttcatccggaaatcggacgaactcctacacaacgtgaacgctggaaaatcaaccaccaacatcatgatcacaaccatcattatcgtcatcatcgtcatactcctctccctaatcgccgtcggcctcctcctgtattgcaaagctcgctccacccccgtcaccctgtccaaagaccaactctccggaatcaacaacatcgccttctcaaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6329 - RNA, 1967 nt, synthetic construct
  misc_feature 1..1967: note = mRNA product Design g-2 comprising derived and/or modified sequence from HRSV(A2)__F_DSCav1_mut6 (opt1)
  source 1..1967: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaaccccgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6330 - RNA, 1967 nt, synthetic construct
  misc_feature 1..1967: note = mRNA product Design g-2 comprising derived and/or modified sequence from HRSV(A2)__F_DSCav1_mut6 (opt1)
  source 1..1967: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctcatgtgcagcacccccgccaccgggtccggcagcgccatcgcctccggcgtggcggtgtgcaaggtcctgcacctggagggggaggtgaacaagatcaagagcgccctcctgtccaccaacaaggccgtggtcagcctgtccaacggcgtgagcgtgctcacgttcaaggtcctggacctgaagaactacatcgacaagcagctcctgccgatcctgaacaagcagtcctgcagcatccccaaccccgagaccgtgatggagttccagcagaagaacaaccggctcctggagatcacccgcgagttctccgtgaacgccggggtcaccacgcccgtgagcacctacatgctgaccaactccgagctcctgagcctgatcaacgacatgccgatcaccaacgaccagaagaagctcatgagcaacaacgtgcagatcgtccggcagcagtcctacagcatcatgtgcatcatcaaggaggaggtgctggcctacgtggtccagctgcccctctacggcgtgatcgacacgccctgctggaagctgcacaccagccccctgtgcaccaccaacacgaaggaggggagcaacatctgcctcacccgcaccgaccggggctggtactgcgacaacgcgggctccgtgagcttcttcccgcaggccgagacctgcaaggtctgctccaaccgcgtgttctgcgacacgatgaacagcctgaccctgccctccgaggtcaacctctgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaacaaggggatcatcaagaccttctccaacggctgcgactacgtgagcaacaagggcgtcgacacggtgtccgtggggaacaccctgtactacgtcaacaagcaggagggccagagcctctacgtgaagggggagcccatcatcaacttctacgacccgctggtgttccccagcgacgagttcgacgcctccatcagccaggtcaacgagaagatcaaccagtccctggcgttcatccggaagtccgacgagctcctgcacaacgtgaacgccggcaagtccaccaccaacatcatgatcaccacgatcatcatcgtgatcatcgtcatcctgctcagcctgatcgccgtggggctgctcctgtactgcaaggcccgctccacccccgtgaccctgagcaaggaccagctgtccggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6331 - RNA, 1967 nt, synthetic construct
  misc_feature 1..1967: note = mRNA product Design g-2 comprising derived and/or modified sequence from HRSV(A2)__F_DSCav1_mut6 (opt2)
  source 1..1967: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6332 - RNA, 1967 nt, synthetic construct
  misc_feature 1..1967: note = mRNA product Design g-2 comprising derived and/or modified sequence from HRSV(A2)__F_DSCav1_mut6 (opt3)
  source 1..1967: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagatgcttatgtgttccacacccgccaccgggtctggatcggctatagcatcaggcgtggccgtctgcaaggtgctgcacttggagggtgaggttaacaaaatcaagagcgctctcctgagtacgaataaagccgtggtctccctgtctaacggggtgagcgtactcacttttaaggttttagatctgaagaattacattgacaaacagcttttgcctatcctgaacaagcaatcctgttcaattccaaatccggaaaccgtgatggagttccagcagaaaaacaataggctactcgaaatcacacgggagtttagtgtcaacgcgggagtgactacccccgtgagcacatatatgctgaccaattctgagcttctgtccttgataaacgatatgcctattacgaacgaccagaagaaactcatgtcaaataacgtccaaatcgttcgccagcagagctacagtattatgtgcatcatcaaggaagaggtgctggcatatgtagtgcagttaccactgtacggcgtcattgatactccctgttggaaactccatacatctcctctttgcaccactaatacaaaggaaggctccaacatatgtctgacccgaacggaccgtgggtggtactgcgataatgccggaagcgtgtcgttctttccacaagctgagacctgtaaggtttgctctaacagagtgttctgcgacacaatgaactccttgactctaccctcagaagtcaatctgtgtaatgtggatatctttaaccctaaatatgactgcaagattatgaccagtaaaacagatgtaagctcctctgttatcactagcctcggtgccatagtgtcatgttacggcaagaccaaatgcacagcaagtaataagaacaaggggattatcaaaaccttctccaatggatgtgactatgtcagcaacaagggcgtggacactgtctctgtgggtaatacgctgtactatgttaacaaacaggaggggcagtcactttacgtgaagggagagccaatcattaacttttatgatccgctggtattccccagtgacgaatttgatgctagcatctcccaagtcaatgagaaaattaaccagtctttggccttcataaggaagtcggacgaactcctgcacaatgtgaacgcgggcaagagcacaaccaatatcatgattactaccatcatcattgttataatcgtgattttactgtccctaatcgccgtcggcctcctgctttactgcaaagcacggtcaacacctgtgaccttgagtaaggatcagctgtctgggattaacaatatcgctttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6333 - RNA, 1967 nt, synthetic construct
  misc_feature 1..1967: note = mRNA product Design g-2 comprising derived and/or modified sequence from HRSV(A2)__F_DSCav1_mut6 (opt4)
  source 1..1967: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6334 - RNA, 1967 nt, synthetic construct
  misc_feature 1..1967: note = mRNA product Design g-2 comprising derived and/or modified sequence from HRSV(A2)__F_DSCav1_mut6 (opt5)
  source 1..1967: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagatgctgatgtgtagcacccccgccacaggatccggctctgctattgccagcggggtcgcggtgtgcaaggttctgcacctcgagggagaggtgaacaaaatcaagtccgccctgcttagcaccaataaagctgtcgtgtctctgtccaacggcgttagcgtgctcacatttaaggtcctggatcttaagaattacattgacaaacagctgctccctatcctgaacaagcaatcttgttccattccgaatcccgaaaccgtgatggagttccagcagaaaaacaatcggctgctcgaaatcacgcgcgagtttagcgtgaacgccggcgtcacaacccctgtttctacatatatgctgaccaattccgagcttctgagcctcattaacgatatgcccatcaccaacgaccagaagaaactgatgtccaataacgtgcaaatcgtgagacagcagtcttacagcattatgtgcatcattaaggaagaggtccttgcttatgtggttcagctgcctctctacggggtgatcgatacaccctgttggaaactgcatacgtcccctctgtgcaccacaaataccaaggaaggaagcaacatttgtctcacacggaccgaccgcggctggtactgcgataatgccgggtctgtctccttctttccgcaagcggagacgtgtaaggtgtgcagcaacagagttttctgcgacacaatgaactctctgacccttcccagcgaagtgaatctgtgtaatgtcgatatctttaaccctaaatatgactgcaagatcatgacctccaaaacagatgtgtctagctccgtcattaccagcctcggagccatcgtgtcttgttacggcaagacaaaatgcacggcttccaataagaacaaggggattatcaaaaccttcagcaatggatgtgactatgtttctaacaagggcgtggacacagtctccgtgggcaataccctgtactatgttaacaaacaggaggggcagagcctttacgtgaagggagagcccattatcaacttttatgatcctctggtcttcccctccgacgaatttgatgcctctatcagccaagtgaatgagaaaattaaccagtccctcgctttcatccggaagtctgacgaactgctgcacaatgtgaacgccggcaagagcacaaccaatattatgatcacgaccattatcattgttatcatcgtcattctcctgtcccttatcgccgtggggctgctcctgtactgcaaagctcgcagcacaccggtgaccctgtctaaggatcagctttccggaattaacaatatcgcgttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6335 - RNA, 1967 nt, synthetic construct
  misc_feature 1..1967: note = mRNA product Design g-2 comprising derived and/or modified sequence from HRSV(A2)__F_DSCav1_mut6 (opt6)
  source 1..1967: mol_type = other RNA
gggagagtccgctcagccaggttgcagaagcggcttagcgtgtgtcctaatcttctctctgcgtgtaggtaggcctgtgccgcaaacaagcttaccatggaactattaatcttaaaagcaaatgctataaccacaatattaacagcagtaacattctgttttgcctccggacaaaacataacagaagaattttatcaatcaacatgctctgcagtatccaaaggttacttaggcgcactacgcactggatggtatacatcagtaataacaatagaactatcaaacataaaagaaaataaatgtaacggtactgacgcaaaagtgaaactaattaaacaagaactcgacaaatacaaaaatgctgtaacagacctacaaatgctaatgtgctcaacacccgcaaccggatcaggatcagccatagcctccggagtcgcagtatgcaaagtattacatcttgaaggagaagtaaataaaataaaatcagcattactatccacaaataaagccgtagtatcactatcaaacggtgtatccgtccttacattcaaagtattagatctaaaaaactacatagataaacaactactacccatcttaaacaaacaatcatgctcaattcccaacccagaaacagtcatggaatttcaacaaaaaaacaacagactcttagaaataacacgagaattttcagtaaacgcaggagtaaccacaccagtaagtacatacatgctcaccaactcagaattattatcacttattaacgacatgccaattacaaacgaccaaaaaaaattaatgtcaaacaatgtccaaattgttagacaacaatcatactctataatgtgtataataaaagaagaagtactagcttacgtagttcaattaccactatatggcgtaatagatacaccttgctggaaactacatacatctccattatgtacaactaacacaaaagaaggatctaacatatgcctaacacgcacagatcgaggatggtactgcgataatgcaggttccgtatcattctttccacaagcagaaacatgtaaagtatgctcaaacagagtattctgtgacactatgaactccttaaccctaccctcagaagtcaatctatgcaacgttgacatatttaacccaaaatacgactgtaaaatcatgacatctaaaacagacgtatcatcatcagttattacatccctaggagcaatagtatcttgctacggaaaaacaaaatgtacagcatccaacaaaaacaaaggaataatcaaaacattctcaaacggctgcgactacgtatcaaacaaaggtgtagacacagtatcagtaggaaatactttatattacgtaaataaacaagaaggacaatctctatacgttaaaggcgaacctattataaacttctacgacccactcgtattcccttcagacgaatttgacgcatctatatcccaagttaacgaaaaaatcaaccaatcattagcctttataagaaaatccgacgaattattacataacgtcaacgctggaaaatcaacaactaacataatgataaccacaataataatagtcatcatagttatattactaagtctaatagccgtaggcctcctactttattgcaaagcaagatcaacaccagtaacattatccaaagaccaactcagcggcataaacaatatagctttttcaaactagggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6336 - RNA, 1967 nt, synthetic construct
  misc_feature 1..1967: note = mRNA product Design g-2 comprising derived and/or modified sequence from HRSV(A2)__F_DSCav1_mut6 (opt11)
  source 1..1967: mol_type = other RNA
gggagagtccgctcagccaggttgcagaagcggcttagcgtgtgtcctaatcttctctctgcgtgtaggtaggcctgtgccgcaaacaagcttaccatggaactcctcatcctcaaagccaacgcaatcacaaccatactaactgcagttactttctgcttcgcatccggccaaaacatcaccgaagagttctaccaatcaacctgctccgcagtctccaaaggatacctcggagcccttcgcaccggctggtacacctccgtcataaccatcgaactctcaaacataaaagaaaacaaatgcaacggcacagacgcgaaagtcaaacttatcaaacaagaactcgacaaatacaaaaacgccgtcaccgacctgcagatgctcatgtgctcaacccccgccacaggaagcggctctgctatcgcttccggcgtcgccgtctgcaaagtcctccacctcgaaggcgaagtaaacaaaatcaagtcagccctcctctccaccaacaaagccgtcgtctctctctcaaacggcgtatccgtcctcacattcaaagtcctcgacctcaaaaactacatcgacaaacaacttctccccatcctaaacaaacaatcatgctccatccccaaccccgaaacagtcatggaatttcaacaaaagaacaaccgcctcttagaaatcacccgagaattttccgtcaacgcgggagtcacaacccccgtttctacgtatatgctcaccaactccgaactcctttccctcataaacgacatgccaatcaccaacgaccaaaagaaactcatgtcaaacaacgtccaaatcgtccgacaacaatcctactctattatgtgcatcatcaaagaagaagttctcgcctacgtcgtccaactacccctctacggcgtgatcgacaccccctgctggaaactacacacctcacccctctgcaccaccaacaccaaggaaggctccaacatctgcctcacccgcaccgaccgcggctggtactgcgacaacgctggctccgtctcattcttcccgcaagccgaaacttgcaaagtatgctccaacagagtattctgcgacaccatgaactcactaaccctcccttccgaagtcaacctttgcaacgttgacatattcaacccaaagtacgattgcaaaattatgacatccaaaacagatgtctcctcctccgtcatcacatccctcggtgccattgtatcatgctacggaaaaaccaaatgcaccgcatccaacaaaaacaaaggaatcatcaaaaccttctcaaacggctgcgattacgtctcaaacaaaggagtcgacacagtctccgtcggaaacaccctatactacgtcaacaaacaagaaggccaatccctgtacgtcaaaggagaacccatcatcaacttctacgaccccctcgtcttcccgagcgacgagttcgacgcctccatctcacaagtcaatgaaaagatcaaccaatcccttgccttcatccggaaatcggacgaactcctacacaacgtgaacgctggaaaatcaaccaccaacatcatgatcacaaccatcattatcgtcatcatcgtcatactcctctccctaatcgccgtcggcctcctcctgtattgcaaagctcgctccacccccgtcaccctgtccaaagaccaactctccggaatcaacaacatcgccttctcaaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6337 - RNA, 2199 nt, synthetic construct
  misc_feature 1..2199: note = mRNA product Design g-3 comprising derived and/or modified sequence from HRSV(A2)__F_DSCav1_mut6 (opt1)
  source 1..2199: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaaccccgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6338 - RNA, 2199 nt, synthetic construct
  misc_feature 1..2199: note = mRNA product Design g-3 comprising derived and/or modified sequence from HRSV(A2)__F_DSCav1_mut6 (opt1)
  source 1..2199: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctcatgtgcagcacccccgccaccgggtccggcagcgccatcgcctccggcgtggcggtgtgcaaggtcctgcacctggagggggaggtgaacaagatcaagagcgccctcctgtccaccaacaaggccgtggtcagcctgtccaacggcgtgagcgtgctcacgttcaaggtcctggacctgaagaactacatcgacaagcagctcctgccgatcctgaacaagcagtcctgcagcatccccaaccccgagaccgtgatggagttccagcagaagaacaaccggctcctggagatcacccgcgagttctccgtgaacgccggggtcaccacgcccgtgagcacctacatgctgaccaactccgagctcctgagcctgatcaacgacatgccgatcaccaacgaccagaagaagctcatgagcaacaacgtgcagatcgtccggcagcagtcctacagcatcatgtgcatcatcaaggaggaggtgctggcctacgtggtccagctgcccctctacggcgtgatcgacacgccctgctggaagctgcacaccagccccctgtgcaccaccaacacgaaggaggggagcaacatctgcctcacccgcaccgaccggggctggtactgcgacaacgcgggctccgtgagcttcttcccgcaggccgagacctgcaaggtctgctccaaccgcgtgttctgcgacacgatgaacagcctgaccctgccctccgaggtcaacctctgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaacaaggggatcatcaagaccttctccaacggctgcgactacgtgagcaacaagggcgtcgacacggtgtccgtggggaacaccctgtactacgtcaacaagcaggagggccagagcctctacgtgaagggggagcccatcatcaacttctacgacccgctggtgttccccagcgacgagttcgacgcctccatcagccaggtcaacgagaagatcaaccagtccctggcgttcatccggaagtccgacgagctcctgcacaacgtgaacgccggcaagtccaccaccaacatcatgatcaccacgatcatcatcgtgatcatcgtcatcctgctcagcctgatcgccgtggggctgctcctgtactgcaaggcccgctccacccccgtgaccctgagcaaggaccagctgtccggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6339 - RNA, 2199 nt, synthetic construct
  misc_feature 1..2199: note = mRNA product Design g-3 comprising derived and/or modified sequence from HRSV(A2)__F_DSCav1_mut6 (opt2)
  source 1..2199: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6340 - RNA, 2199 nt, synthetic construct
  misc_feature 1..2199: note = mRNA product Design g-3 comprising derived and/or modified sequence from HRSV(A2)__F_DSCav1_mut6 (opt3)
  source 1..2199: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagatgcttatgtgttccacacccgccaccgggtctggatcggctatagcatcaggcgtggccgtctgcaaggtgctgcacttggagggtgaggttaacaaaatcaagagcgctctcctgagtacgaataaagccgtggtctccctgtctaacggggtgagcgtactcacttttaaggttttagatctgaagaattacattgacaaacagcttttgcctatcctgaacaagcaatcctgttcaattccaaatccggaaaccgtgatggagttccagcagaaaaacaataggctactcgaaatcacacgggagtttagtgtcaacgcgggagtgactacccccgtgagcacatatatgctgaccaattctgagcttctgtccttgataaacgatatgcctattacgaacgaccagaagaaactcatgtcaaataacgtccaaatcgttcgccagcagagctacagtattatgtgcatcatcaaggaagaggtgctggcatatgtagtgcagttaccactgtacggcgtcattgatactccctgttggaaactccatacatctcctctttgcaccactaatacaaaggaaggctccaacatatgtctgacccgaacggaccgtgggtggtactgcgataatgccggaagcgtgtcgttctttccacaagctgagacctgtaaggtttgctctaacagagtgttctgcgacacaatgaactccttgactctaccctcagaagtcaatctgtgtaatgtggatatctttaaccctaaatatgactgcaagattatgaccagtaaaacagatgtaagctcctctgttatcactagcctcggtgccatagtgtcatgttacggcaagaccaaatgcacagcaagtaataagaacaaggggattatcaaaaccttctccaatggatgtgactatgtcagcaacaagggcgtggacactgtctctgtgggtaatacgctgtactatgttaacaaacaggaggggcagtcactttacgtgaagggagagccaatcattaacttttatgatccgctggtattccccagtgacgaatttgatgctagcatctcccaagtcaatgagaaaattaaccagtctttggccttcataaggaagtcggacgaactcctgcacaatgtgaacgcgggcaagagcacaaccaatatcatgattactaccatcatcattgttataatcgtgattttactgtccctaatcgccgtcggcctcctgctttactgcaaagcacggtcaacacctgtgaccttgagtaaggatcagctgtctgggattaacaatatcgctttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6341 - RNA, 2199 nt, synthetic construct
  misc_feature 1..2199: note = mRNA product Design g-3 comprising derived and/or modified sequence from HRSV(A2)__F_DSCav1_mut6 (opt4)
  source 1..2199: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6342 - RNA, 2199 nt, synthetic construct
  misc_feature 1..2199: note = mRNA product Design g-3 comprising derived and/or modified sequence from HRSV(A2)__F_DSCav1_mut6 (opt5)
  source 1..2199: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagatgctgatgtgtagcacccccgccacaggatccggctctgctattgccagcggggtcgcggtgtgcaaggttctgcacctcgagggagaggtgaacaaaatcaagtccgccctgcttagcaccaataaagctgtcgtgtctctgtccaacggcgttagcgtgctcacatttaaggtcctggatcttaagaattacattgacaaacagctgctccctatcctgaacaagcaatcttgttccattccgaatcccgaaaccgtgatggagttccagcagaaaaacaatcggctgctcgaaatcacgcgcgagtttagcgtgaacgccggcgtcacaacccctgtttctacatatatgctgaccaattccgagcttctgagcctcattaacgatatgcccatcaccaacgaccagaagaaactgatgtccaataacgtgcaaatcgtgagacagcagtcttacagcattatgtgcatcattaaggaagaggtccttgcttatgtggttcagctgcctctctacggggtgatcgatacaccctgttggaaactgcatacgtcccctctgtgcaccacaaataccaaggaaggaagcaacatttgtctcacacggaccgaccgcggctggtactgcgataatgccgggtctgtctccttctttccgcaagcggagacgtgtaaggtgtgcagcaacagagttttctgcgacacaatgaactctctgacccttcccagcgaagtgaatctgtgtaatgtcgatatctttaaccctaaatatgactgcaagatcatgacctccaaaacagatgtgtctagctccgtcattaccagcctcggagccatcgtgtcttgttacggcaagacaaaatgcacggcttccaataagaacaaggggattatcaaaaccttcagcaatggatgtgactatgtttctaacaagggcgtggacacagtctccgtgggcaataccctgtactatgttaacaaacaggaggggcagagcctttacgtgaagggagagcccattatcaacttttatgatcctctggtcttcccctccgacgaatttgatgcctctatcagccaagtgaatgagaaaattaaccagtccctcgctttcatccggaagtctgacgaactgctgcacaatgtgaacgccggcaagagcacaaccaatattatgatcacgaccattatcattgttatcatcgtcattctcctgtcccttatcgccgtggggctgctcctgtactgcaaagctcgcagcacaccggtgaccctgtctaaggatcagctttccggaattaacaatatcgcgttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6343 - RNA, 2199 nt, synthetic construct
  misc_feature 1..2199: note = mRNA product Design g-3 comprising derived and/or modified sequence from HRSV(A2)__F_DSCav1_mut6 (opt6)
  source 1..2199: mol_type = other RNA
gggagagtccgctcagccaggttgcagaagcggcttagcgtgtgtcctaatcttctctctgcgtgtaggtaggcctgtgccgcaaacaagcttaccatggaactattaatcttaaaagcaaatgctataaccacaatattaacagcagtaacattctgttttgcctccggacaaaacataacagaagaattttatcaatcaacatgctctgcagtatccaaaggttacttaggcgcactacgcactggatggtatacatcagtaataacaatagaactatcaaacataaaagaaaataaatgtaacggtactgacgcaaaagtgaaactaattaaacaagaactcgacaaatacaaaaatgctgtaacagacctacaaatgctaatgtgctcaacacccgcaaccggatcaggatcagccatagcctccggagtcgcagtatgcaaagtattacatcttgaaggagaagtaaataaaataaaatcagcattactatccacaaataaagccgtagtatcactatcaaacggtgtatccgtccttacattcaaagtattagatctaaaaaactacatagataaacaactactacccatcttaaacaaacaatcatgctcaattcccaacccagaaacagtcatggaatttcaacaaaaaaacaacagactcttagaaataacacgagaattttcagtaaacgcaggagtaaccacaccagtaagtacatacatgctcaccaactcagaattattatcacttattaacgacatgccaattacaaacgaccaaaaaaaattaatgtcaaacaatgtccaaattgttagacaacaatcatactctataatgtgtataataaaagaagaagtactagcttacgtagttcaattaccactatatggcgtaatagatacaccttgctggaaactacatacatctccattatgtacaactaacacaaaagaaggatctaacatatgcctaacacgcacagatcgaggatggtactgcgataatgcaggttccgtatcattctttccacaagcagaaacatgtaaagtatgctcaaacagagtattctgtgacactatgaactccttaaccctaccctcagaagtcaatctatgcaacgttgacatatttaacccaaaatacgactgtaaaatcatgacatctaaaacagacgtatcatcatcagttattacatccctaggagcaatagtatcttgctacggaaaaacaaaatgtacagcatccaacaaaaacaaaggaataatcaaaacattctcaaacggctgcgactacgtatcaaacaaaggtgtagacacagtatcagtaggaaatactttatattacgtaaataaacaagaaggacaatctctatacgttaaaggcgaacctattataaacttctacgacccactcgtattcccttcagacgaatttgacgcatctatatcccaagttaacgaaaaaatcaaccaatcattagcctttataagaaaatccgacgaattattacataacgtcaacgctggaaaatcaacaactaacataatgataaccacaataataatagtcatcatagttatattactaagtctaatagccgtaggcctcctactttattgcaaagcaagatcaacaccagtaacattatccaaagaccaactcagcggcataaacaatatagctttttcaaactagggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6344 - RNA, 2199 nt, synthetic construct
  misc_feature 1..2199: note = mRNA product Design g-3 comprising derived and/or modified sequence from HRSV(A2)__F_DSCav1_mut6 (opt11)
  source 1..2199: mol_type = other RNA
gggagagtccgctcagccaggttgcagaagcggcttagcgtgtgtcctaatcttctctctgcgtgtaggtaggcctgtgccgcaaacaagcttaccatggaactcctcatcctcaaagccaacgcaatcacaaccatactaactgcagttactttctgcttcgcatccggccaaaacatcaccgaagagttctaccaatcaacctgctccgcagtctccaaaggatacctcggagcccttcgcaccggctggtacacctccgtcataaccatcgaactctcaaacataaaagaaaacaaatgcaacggcacagacgcgaaagtcaaacttatcaaacaagaactcgacaaatacaaaaacgccgtcaccgacctgcagatgctcatgtgctcaacccccgccacaggaagcggctctgctatcgcttccggcgtcgccgtctgcaaagtcctccacctcgaaggcgaagtaaacaaaatcaagtcagccctcctctccaccaacaaagccgtcgtctctctctcaaacggcgtatccgtcctcacattcaaagtcctcgacctcaaaaactacatcgacaaacaacttctccccatcctaaacaaacaatcatgctccatccccaaccccgaaacagtcatggaatttcaacaaaagaacaaccgcctcttagaaatcacccgagaattttccgtcaacgcgggagtcacaacccccgtttctacgtatatgctcaccaactccgaactcctttccctcataaacgacatgccaatcaccaacgaccaaaagaaactcatgtcaaacaacgtccaaatcgtccgacaacaatcctactctattatgtgcatcatcaaagaagaagttctcgcctacgtcgtccaactacccctctacggcgtgatcgacaccccctgctggaaactacacacctcacccctctgcaccaccaacaccaaggaaggctccaacatctgcctcacccgcaccgaccgcggctggtactgcgacaacgctggctccgtctcattcttcccgcaagccgaaacttgcaaagtatgctccaacagagtattctgcgacaccatgaactcactaaccctcccttccgaagtcaacctttgcaacgttgacatattcaacccaaagtacgattgcaaaattatgacatccaaaacagatgtctcctcctccgtcatcacatccctcggtgccattgtatcatgctacggaaaaaccaaatgcaccgcatccaacaaaaacaaaggaatcatcaaaaccttctcaaacggctgcgattacgtctcaaacaaaggagtcgacacagtctccgtcggaaacaccctatactacgtcaacaaacaagaaggccaatccctgtacgtcaaaggagaacccatcatcaacttctacgaccccctcgtcttcccgagcgacgagttcgacgcctccatctcacaagtcaatgaaaagatcaaccaatcccttgccttcatccggaaatcggacgaactcctacacaacgtgaacgctggaaaatcaaccaccaacatcatgatcacaaccatcattatcgtcatcatcgtcatactcctctccctaatcgccgtcggcctcctcctgtattgcaaagctcgctccacccccgtcaccctgtccaaagaccaactctccggaatcaacaacatcgccttctcaaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6345 - RNA, 1994 nt, synthetic construct
  misc_feature 1..1994: note = mRNA product Design g-4 comprising derived and/or modified sequence from HRSV(A2)__F_DSCav1_mut6 (opt1)
  source 1..1994: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaaccccgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6346 - RNA, 1994 nt, synthetic construct
  misc_feature 1..1994: note = mRNA product Design g-4 comprising derived and/or modified sequence from HRSV(A2)__F_DSCav1_mut6 (opt1)
  source 1..1994: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctcatgtgcagcacccccgccaccgggtccggcagcgccatcgcctccggcgtggcggtgtgcaaggtcctgcacctggagggggaggtgaacaagatcaagagcgccctcctgtccaccaacaaggccgtggtcagcctgtccaacggcgtgagcgtgctcacgttcaaggtcctggacctgaagaactacatcgacaagcagctcctgccgatcctgaacaagcagtcctgcagcatccccaaccccgagaccgtgatggagttccagcagaagaacaaccggctcctggagatcacccgcgagttctccgtgaacgccggggtcaccacgcccgtgagcacctacatgctgaccaactccgagctcctgagcctgatcaacgacatgccgatcaccaacgaccagaagaagctcatgagcaacaacgtgcagatcgtccggcagcagtcctacagcatcatgtgcatcatcaaggaggaggtgctggcctacgtggtccagctgcccctctacggcgtgatcgacacgccctgctggaagctgcacaccagccccctgtgcaccaccaacacgaaggaggggagcaacatctgcctcacccgcaccgaccggggctggtactgcgacaacgcgggctccgtgagcttcttcccgcaggccgagacctgcaaggtctgctccaaccgcgtgttctgcgacacgatgaacagcctgaccctgccctccgaggtcaacctctgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaacaaggggatcatcaagaccttctccaacggctgcgactacgtgagcaacaagggcgtcgacacggtgtccgtggggaacaccctgtactacgtcaacaagcaggagggccagagcctctacgtgaagggggagcccatcatcaacttctacgacccgctggtgttccccagcgacgagttcgacgcctccatcagccaggtcaacgagaagatcaaccagtccctggcgttcatccggaagtccgacgagctcctgcacaacgtgaacgccggcaagtccaccaccaacatcatgatcaccacgatcatcatcgtgatcatcgtcatcctgctcagcctgatcgccgtggggctgctcctgtactgcaaggcccgctccacccccgtgaccctgagcaaggaccagctgtccggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6347 - RNA, 1994 nt, synthetic construct
  misc_feature 1..1994: note = mRNA product Design g-4 comprising derived and/or modified sequence from HRSV(A2)__F_DSCav1_mut6 (opt2)
  source 1..1994: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6348 - RNA, 1994 nt, synthetic construct
  misc_feature 1..1994: note = mRNA product Design g-4 comprising derived and/or modified sequence from HRSV(A2)__F_DSCav1_mut6 (opt3)
  source 1..1994: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagatgcttatgtgttccacacccgccaccgggtctggatcggctatagcatcaggcgtggccgtctgcaaggtgctgcacttggagggtgaggttaacaaaatcaagagcgctctcctgagtacgaataaagccgtggtctccctgtctaacggggtgagcgtactcacttttaaggttttagatctgaagaattacattgacaaacagcttttgcctatcctgaacaagcaatcctgttcaattccaaatccggaaaccgtgatggagttccagcagaaaaacaataggctactcgaaatcacacgggagtttagtgtcaacgcgggagtgactacccccgtgagcacatatatgctgaccaattctgagcttctgtccttgataaacgatatgcctattacgaacgaccagaagaaactcatgtcaaataacgtccaaatcgttcgccagcagagctacagtattatgtgcatcatcaaggaagaggtgctggcatatgtagtgcagttaccactgtacggcgtcattgatactccctgttggaaactccatacatctcctctttgcaccactaatacaaaggaaggctccaacatatgtctgacccgaacggaccgtgggtggtactgcgataatgccggaagcgtgtcgttctttccacaagctgagacctgtaaggtttgctctaacagagtgttctgcgacacaatgaactccttgactctaccctcagaagtcaatctgtgtaatgtggatatctttaaccctaaatatgactgcaagattatgaccagtaaaacagatgtaagctcctctgttatcactagcctcggtgccatagtgtcatgttacggcaagaccaaatgcacagcaagtaataagaacaaggggattatcaaaaccttctccaatggatgtgactatgtcagcaacaagggcgtggacactgtctctgtgggtaatacgctgtactatgttaacaaacaggaggggcagtcactttacgtgaagggagagccaatcattaacttttatgatccgctggtattccccagtgacgaatttgatgctagcatctcccaagtcaatgagaaaattaaccagtctttggccttcataaggaagtcggacgaactcctgcacaatgtgaacgcgggcaagagcacaaccaatatcatgattactaccatcatcattgttataatcgtgattttactgtccctaatcgccgtcggcctcctgctttactgcaaagcacggtcaacacctgtgaccttgagtaaggatcagctgtctgggattaacaatatcgctttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6349 - RNA, 1994 nt, synthetic construct
  misc_feature 1..1994: note = mRNA product Design g-4 comprising derived and/or modified sequence from HRSV(A2)__F_DSCav1_mut6 (opt4)
  source 1..1994: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6350 - RNA, 1994 nt, synthetic construct
  misc_feature 1..1994: note = mRNA product Design g-4 comprising derived and/or modified sequence from HRSV(A2)__F_DSCav1_mut6 (opt5)
  source 1..1994: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagatgctgatgtgtagcacccccgccacaggatccggctctgctattgccagcggggtcgcggtgtgcaaggttctgcacctcgagggagaggtgaacaaaatcaagtccgccctgcttagcaccaataaagctgtcgtgtctctgtccaacggcgttagcgtgctcacatttaaggtcctggatcttaagaattacattgacaaacagctgctccctatcctgaacaagcaatcttgttccattccgaatcccgaaaccgtgatggagttccagcagaaaaacaatcggctgctcgaaatcacgcgcgagtttagcgtgaacgccggcgtcacaacccctgtttctacatatatgctgaccaattccgagcttctgagcctcattaacgatatgcccatcaccaacgaccagaagaaactgatgtccaataacgtgcaaatcgtgagacagcagtcttacagcattatgtgcatcattaaggaagaggtccttgcttatgtggttcagctgcctctctacggggtgatcgatacaccctgttggaaactgcatacgtcccctctgtgcaccacaaataccaaggaaggaagcaacatttgtctcacacggaccgaccgcggctggtactgcgataatgccgggtctgtctccttctttccgcaagcggagacgtgtaaggtgtgcagcaacagagttttctgcgacacaatgaactctctgacccttcccagcgaagtgaatctgtgtaatgtcgatatctttaaccctaaatatgactgcaagatcatgacctccaaaacagatgtgtctagctccgtcattaccagcctcggagccatcgtgtcttgttacggcaagacaaaatgcacggcttccaataagaacaaggggattatcaaaaccttcagcaatggatgtgactatgtttctaacaagggcgtggacacagtctccgtgggcaataccctgtactatgttaacaaacaggaggggcagagcctttacgtgaagggagagcccattatcaacttttatgatcctctggtcttcccctccgacgaatttgatgcctctatcagccaagtgaatgagaaaattaaccagtccctcgctttcatccggaagtctgacgaactgctgcacaatgtgaacgccggcaagagcacaaccaatattatgatcacgaccattatcattgttatcatcgtcattctcctgtcccttatcgccgtggggctgctcctgtactgcaaagctcgcagcacaccggtgaccctgtctaaggatcagctttccggaattaacaatatcgcgttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6351 - RNA, 1994 nt, synthetic construct
  misc_feature 1..1994: note = mRNA product Design g-4 comprising derived and/or modified sequence from HRSV(A2)__F_DSCav1_mut6 (opt6)
  source 1..1994: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactattaatcttaaaagcaaatgctataaccacaatattaacagcagtaacattctgttttgcctccggacaaaacataacagaagaattttatcaatcaacatgctctgcagtatccaaaggttacttaggcgcactacgcactggatggtatacatcagtaataacaatagaactatcaaacataaaagaaaataaatgtaacggtactgacgcaaaagtgaaactaattaaacaagaactcgacaaatacaaaaatgctgtaacagacctacaaatgctaatgtgctcaacacccgcaaccggatcaggatcagccatagcctccggagtcgcagtatgcaaagtattacatcttgaaggagaagtaaataaaataaaatcagcattactatccacaaataaagccgtagtatcactatcaaacggtgtatccgtccttacattcaaagtattagatctaaaaaactacatagataaacaactactacccatcttaaacaaacaatcatgctcaattcccaacccagaaacagtcatggaatttcaacaaaaaaacaacagactcttagaaataacacgagaattttcagtaaacgcaggagtaaccacaccagtaagtacatacatgctcaccaactcagaattattatcacttattaacgacatgccaattacaaacgaccaaaaaaaattaatgtcaaacaatgtccaaattgttagacaacaatcatactctataatgtgtataataaaagaagaagtactagcttacgtagttcaattaccactatatggcgtaatagatacaccttgctggaaactacatacatctccattatgtacaactaacacaaaagaaggatctaacatatgcctaacacgcacagatcgaggatggtactgcgataatgcaggttccgtatcattctttccacaagcagaaacatgtaaagtatgctcaaacagagtattctgtgacactatgaactccttaaccctaccctcagaagtcaatctatgcaacgttgacatatttaacccaaaatacgactgtaaaatcatgacatctaaaacagacgtatcatcatcagttattacatccctaggagcaatagtatcttgctacggaaaaacaaaatgtacagcatccaacaaaaacaaaggaataatcaaaacattctcaaacggctgcgactacgtatcaaacaaaggtgtagacacagtatcagtaggaaatactttatattacgtaaataaacaagaaggacaatctctatacgttaaaggcgaacctattataaacttctacgacccactcgtattcccttcagacgaatttgacgcatctatatcccaagttaacgaaaaaatcaaccaatcattagcctttataagaaaatccgacgaattattacataacgtcaacgctggaaaatcaacaactaacataatgataaccacaataataatagtcatcatagttatattactaagtctaatagccgtaggcctcctactttattgcaaagcaagatcaacaccagtaacattatccaaagaccaactcagcggcataaacaatatagctttttcaaactagggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6352 - RNA, 1994 nt, synthetic construct
  misc_feature 1..1994: note = mRNA product Design g-4 comprising derived and/or modified sequence from HRSV(A2)__F_DSCav1_mut6 (opt11)
  source 1..1994: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactcctcatcctcaaagccaacgcaatcacaaccatactaactgcagttactttctgcttcgcatccggccaaaacatcaccgaagagttctaccaatcaacctgctccgcagtctccaaaggatacctcggagcccttcgcaccggctggtacacctccgtcataaccatcgaactctcaaacataaaagaaaacaaatgcaacggcacagacgcgaaagtcaaacttatcaaacaagaactcgacaaatacaaaaacgccgtcaccgacctgcagatgctcatgtgctcaacccccgccacaggaagcggctctgctatcgcttccggcgtcgccgtctgcaaagtcctccacctcgaaggcgaagtaaacaaaatcaagtcagccctcctctccaccaacaaagccgtcgtctctctctcaaacggcgtatccgtcctcacattcaaagtcctcgacctcaaaaactacatcgacaaacaacttctccccatcctaaacaaacaatcatgctccatccccaaccccgaaacagtcatggaatttcaacaaaagaacaaccgcctcttagaaatcacccgagaattttccgtcaacgcgggagtcacaacccccgtttctacgtatatgctcaccaactccgaactcctttccctcataaacgacatgccaatcaccaacgaccaaaagaaactcatgtcaaacaacgtccaaatcgtccgacaacaatcctactctattatgtgcatcatcaaagaagaagttctcgcctacgtcgtccaactacccctctacggcgtgatcgacaccccctgctggaaactacacacctcacccctctgcaccaccaacaccaaggaaggctccaacatctgcctcacccgcaccgaccgcggctggtactgcgacaacgctggctccgtctcattcttcccgcaagccgaaacttgcaaagtatgctccaacagagtattctgcgacaccatgaactcactaaccctcccttccgaagtcaacctttgcaacgttgacatattcaacccaaagtacgattgcaaaattatgacatccaaaacagatgtctcctcctccgtcatcacatccctcggtgccattgtatcatgctacggaaaaaccaaatgcaccgcatccaacaaaaacaaaggaatcatcaaaaccttctcaaacggctgcgattacgtctcaaacaaaggagtcgacacagtctccgtcggaaacaccctatactacgtcaacaaacaagaaggccaatccctgtacgtcaaaggagaacccatcatcaacttctacgaccccctcgtcttcccgagcgacgagttcgacgcctccatctcacaagtcaatgaaaagatcaaccaatcccttgccttcatccggaaatcggacgaactcctacacaacgtgaacgctggaaaatcaaccaccaacatcatgatcacaaccatcattatcgtcatcatcgtcatactcctctccctaatcgccgtcggcctcctcctgtattgcaaagctcgctccacccccgtcaccctgtccaaagaccaactctccggaatcaacaacatcgccttctcaaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6353 - RNA, 1970 nt, synthetic construct
  misc_feature 1..1970: note = mRNA product Design g-5 comprising derived and/or modified sequence from HRSV(A2)__F_DSCav1_mut6 (opt1)
  source 1..1970: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaaccccgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6354 - RNA, 1970 nt, synthetic construct
  misc_feature 1..1970: note = mRNA product Design g-5 comprising derived and/or modified sequence from HRSV(A2)__F_DSCav1_mut6 (opt1)
  source 1..1970: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctcatgtgcagcacccccgccaccgggtccggcagcgccatcgcctccggcgtggcggtgtgcaaggtcctgcacctggagggggaggtgaacaagatcaagagcgccctcctgtccaccaacaaggccgtggtcagcctgtccaacggcgtgagcgtgctcacgttcaaggtcctggacctgaagaactacatcgacaagcagctcctgccgatcctgaacaagcagtcctgcagcatccccaaccccgagaccgtgatggagttccagcagaagaacaaccggctcctggagatcacccgcgagttctccgtgaacgccggggtcaccacgcccgtgagcacctacatgctgaccaactccgagctcctgagcctgatcaacgacatgccgatcaccaacgaccagaagaagctcatgagcaacaacgtgcagatcgtccggcagcagtcctacagcatcatgtgcatcatcaaggaggaggtgctggcctacgtggtccagctgcccctctacggcgtgatcgacacgccctgctggaagctgcacaccagccccctgtgcaccaccaacacgaaggaggggagcaacatctgcctcacccgcaccgaccggggctggtactgcgacaacgcgggctccgtgagcttcttcccgcaggccgagacctgcaaggtctgctccaaccgcgtgttctgcgacacgatgaacagcctgaccctgccctccgaggtcaacctctgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaacaaggggatcatcaagaccttctccaacggctgcgactacgtgagcaacaagggcgtcgacacggtgtccgtggggaacaccctgtactacgtcaacaagcaggagggccagagcctctacgtgaagggggagcccatcatcaacttctacgacccgctggtgttccccagcgacgagttcgacgcctccatcagccaggtcaacgagaagatcaaccagtccctggcgttcatccggaagtccgacgagctcctgcacaacgtgaacgccggcaagtccaccaccaacatcatgatcaccacgatcatcatcgtgatcatcgtcatcctgctcagcctgatcgccgtggggctgctcctgtactgcaaggcccgctccacccccgtgaccctgagcaaggaccagctgtccggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6355 - RNA, 1970 nt, synthetic construct
  misc_feature 1..1970: note = mRNA product Design g-5 comprising derived and/or modified sequence from HRSV(A2)__F_DSCav1_mut6 (opt2)
  source 1..1970: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6356 - RNA, 1970 nt, synthetic construct
  misc_feature 1..1970: note = mRNA product Design g-5 comprising derived and/or modified sequence from HRSV(A2)__F_DSCav1_mut6 (opt3)
  source 1..1970: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagatgcttatgtgttccacacccgccaccgggtctggatcggctatagcatcaggcgtggccgtctgcaaggtgctgcacttggagggtgaggttaacaaaatcaagagcgctctcctgagtacgaataaagccgtggtctccctgtctaacggggtgagcgtactcacttttaaggttttagatctgaagaattacattgacaaacagcttttgcctatcctgaacaagcaatcctgttcaattccaaatccggaaaccgtgatggagttccagcagaaaaacaataggctactcgaaatcacacgggagtttagtgtcaacgcgggagtgactacccccgtgagcacatatatgctgaccaattctgagcttctgtccttgataaacgatatgcctattacgaacgaccagaagaaactcatgtcaaataacgtccaaatcgttcgccagcagagctacagtattatgtgcatcatcaaggaagaggtgctggcatatgtagtgcagttaccactgtacggcgtcattgatactccctgttggaaactccatacatctcctctttgcaccactaatacaaaggaaggctccaacatatgtctgacccgaacggaccgtgggtggtactgcgataatgccggaagcgtgtcgttctttccacaagctgagacctgtaaggtttgctctaacagagtgttctgcgacacaatgaactccttgactctaccctcagaagtcaatctgtgtaatgtggatatctttaaccctaaatatgactgcaagattatgaccagtaaaacagatgtaagctcctctgttatcactagcctcggtgccatagtgtcatgttacggcaagaccaaatgcacagcaagtaataagaacaaggggattatcaaaaccttctccaatggatgtgactatgtcagcaacaagggcgtggacactgtctctgtgggtaatacgctgtactatgttaacaaacaggaggggcagtcactttacgtgaagggagagccaatcattaacttttatgatccgctggtattccccagtgacgaatttgatgctagcatctcccaagtcaatgagaaaattaaccagtctttggccttcataaggaagtcggacgaactcctgcacaatgtgaacgcgggcaagagcacaaccaatatcatgattactaccatcatcattgttataatcgtgattttactgtccctaatcgccgtcggcctcctgctttactgcaaagcacggtcaacacctgtgaccttgagtaaggatcagctgtctgggattaacaatatcgctttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6357 - RNA, 1970 nt, synthetic construct
  misc_feature 1..1970: note = mRNA product Design g-5 comprising derived and/or modified sequence from HRSV(A2)__F_DSCav1_mut6 (opt4)
  source 1..1970: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6358 - RNA, 1970 nt, synthetic construct
  misc_feature 1..1970: note = mRNA product Design g-5 comprising derived and/or modified sequence from HRSV(A2)__F_DSCav1_mut6 (opt5)
  source 1..1970: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagatgctgatgtgtagcacccccgccacaggatccggctctgctattgccagcggggtcgcggtgtgcaaggttctgcacctcgagggagaggtgaacaaaatcaagtccgccctgcttagcaccaataaagctgtcgtgtctctgtccaacggcgttagcgtgctcacatttaaggtcctggatcttaagaattacattgacaaacagctgctccctatcctgaacaagcaatcttgttccattccgaatcccgaaaccgtgatggagttccagcagaaaaacaatcggctgctcgaaatcacgcgcgagtttagcgtgaacgccggcgtcacaacccctgtttctacatatatgctgaccaattccgagcttctgagcctcattaacgatatgcccatcaccaacgaccagaagaaactgatgtccaataacgtgcaaatcgtgagacagcagtcttacagcattatgtgcatcattaaggaagaggtccttgcttatgtggttcagctgcctctctacggggtgatcgatacaccctgttggaaactgcatacgtcccctctgtgcaccacaaataccaaggaaggaagcaacatttgtctcacacggaccgaccgcggctggtactgcgataatgccgggtctgtctccttctttccgcaagcggagacgtgtaaggtgtgcagcaacagagttttctgcgacacaatgaactctctgacccttcccagcgaagtgaatctgtgtaatgtcgatatctttaaccctaaatatgactgcaagatcatgacctccaaaacagatgtgtctagctccgtcattaccagcctcggagccatcgtgtcttgttacggcaagacaaaatgcacggcttccaataagaacaaggggattatcaaaaccttcagcaatggatgtgactatgtttctaacaagggcgtggacacagtctccgtgggcaataccctgtactatgttaacaaacaggaggggcagagcctttacgtgaagggagagcccattatcaacttttatgatcctctggtcttcccctccgacgaatttgatgcctctatcagccaagtgaatgagaaaattaaccagtccctcgctttcatccggaagtctgacgaactgctgcacaatgtgaacgccggcaagagcacaaccaatattatgatcacgaccattatcattgttatcatcgtcattctcctgtcccttatcgccgtggggctgctcctgtactgcaaagctcgcagcacaccggtgaccctgtctaaggatcagctttccggaattaacaatatcgcgttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6359 - RNA, 1970 nt, synthetic construct
  misc_feature 1..1970: note = mRNA product Design g-5 comprising derived and/or modified sequence from HRSV(A2)__F_DSCav1_mut6 (opt6)
  source 1..1970: mol_type = other RNA
gggagacccgtgacccggaagttgtacggctacgcgactttccctcccacaaaccctcgcgcccttcctttcctacttgggcccggcagaaagcttaccatggaactattaatcttaaaagcaaatgctataaccacaatattaacagcagtaacattctgttttgcctccggacaaaacataacagaagaattttatcaatcaacatgctctgcagtatccaaaggttacttaggcgcactacgcactggatggtatacatcagtaataacaatagaactatcaaacataaaagaaaataaatgtaacggtactgacgcaaaagtgaaactaattaaacaagaactcgacaaatacaaaaatgctgtaacagacctacaaatgctaatgtgctcaacacccgcaaccggatcaggatcagccatagcctccggagtcgcagtatgcaaagtattacatcttgaaggagaagtaaataaaataaaatcagcattactatccacaaataaagccgtagtatcactatcaaacggtgtatccgtccttacattcaaagtattagatctaaaaaactacatagataaacaactactacccatcttaaacaaacaatcatgctcaattcccaacccagaaacagtcatggaatttcaacaaaaaaacaacagactcttagaaataacacgagaattttcagtaaacgcaggagtaaccacaccagtaagtacatacatgctcaccaactcagaattattatcacttattaacgacatgccaattacaaacgaccaaaaaaaattaatgtcaaacaatgtccaaattgttagacaacaatcatactctataatgtgtataataaaagaagaagtactagcttacgtagttcaattaccactatatggcgtaatagatacaccttgctggaaactacatacatctccattatgtacaactaacacaaaagaaggatctaacatatgcctaacacgcacagatcgaggatggtactgcgataatgcaggttccgtatcattctttccacaagcagaaacatgtaaagtatgctcaaacagagtattctgtgacactatgaactccttaaccctaccctcagaagtcaatctatgcaacgttgacatatttaacccaaaatacgactgtaaaatcatgacatctaaaacagacgtatcatcatcagttattacatccctaggagcaatagtatcttgctacggaaaaacaaaatgtacagcatccaacaaaaacaaaggaataatcaaaacattctcaaacggctgcgactacgtatcaaacaaaggtgtagacacagtatcagtaggaaatactttatattacgtaaataaacaagaaggacaatctctatacgttaaaggcgaacctattataaacttctacgacccactcgtattcccttcagacgaatttgacgcatctatatcccaagttaacgaaaaaatcaaccaatcattagcctttataagaaaatccgacgaattattacataacgtcaacgctggaaaatcaacaactaacataatgataaccacaataataatagtcatcatagttatattactaagtctaatagccgtaggcctcctactttattgcaaagcaagatcaacaccagtaacattatccaaagaccaactcagcggcataaacaatatagctttttcaaactagggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6360 - RNA, 1970 nt, synthetic construct
  misc_feature 1..1970: note = mRNA product Design g-5 comprising derived and/or modified sequence from HRSV(A2)__F_DSCav1_mut6 (opt11)
  source 1..1970: mol_type = other RNA
gggagacccgtgacccggaagttgtacggctacgcgactttccctcccacaaaccctcgcgcccttcctttcctacttgggcccggcagaaagcttaccatggaactcctcatcctcaaagccaacgcaatcacaaccatactaactgcagttactttctgcttcgcatccggccaaaacatcaccgaagagttctaccaatcaacctgctccgcagtctccaaaggatacctcggagcccttcgcaccggctggtacacctccgtcataaccatcgaactctcaaacataaaagaaaacaaatgcaacggcacagacgcgaaagtcaaacttatcaaacaagaactcgacaaatacaaaaacgccgtcaccgacctgcagatgctcatgtgctcaacccccgccacaggaagcggctctgctatcgcttccggcgtcgccgtctgcaaagtcctccacctcgaaggcgaagtaaacaaaatcaagtcagccctcctctccaccaacaaagccgtcgtctctctctcaaacggcgtatccgtcctcacattcaaagtcctcgacctcaaaaactacatcgacaaacaacttctccccatcctaaacaaacaatcatgctccatccccaaccccgaaacagtcatggaatttcaacaaaagaacaaccgcctcttagaaatcacccgagaattttccgtcaacgcgggagtcacaacccccgtttctacgtatatgctcaccaactccgaactcctttccctcataaacgacatgccaatcaccaacgaccaaaagaaactcatgtcaaacaacgtccaaatcgtccgacaacaatcctactctattatgtgcatcatcaaagaagaagttctcgcctacgtcgtccaactacccctctacggcgtgatcgacaccccctgctggaaactacacacctcacccctctgcaccaccaacaccaaggaaggctccaacatctgcctcacccgcaccgaccgcggctggtactgcgacaacgctggctccgtctcattcttcccgcaagccgaaacttgcaaagtatgctccaacagagtattctgcgacaccatgaactcactaaccctcccttccgaagtcaacctttgcaacgttgacatattcaacccaaagtacgattgcaaaattatgacatccaaaacagatgtctcctcctccgtcatcacatccctcggtgccattgtatcatgctacggaaaaaccaaatgcaccgcatccaacaaaaacaaaggaatcatcaaaaccttctcaaacggctgcgattacgtctcaaacaaaggagtcgacacagtctccgtcggaaacaccctatactacgtcaacaaacaagaaggccaatccctgtacgtcaaaggagaacccatcatcaacttctacgaccccctcgtcttcccgagcgacgagttcgacgcctccatctcacaagtcaatgaaaagatcaaccaatcccttgccttcatccggaaatcggacgaactcctacacaacgtgaacgctggaaaatcaaccaccaacatcatgatcacaaccatcattatcgtcatcatcgtcatactcctctccctaatcgccgtcggcctcctcctgtattgcaaagctcgctccacccccgtcaccctgtccaaagaccaactctccggaatcaacaacatcgccttctcaaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6361 - RNA, 1986 nt, synthetic construct
  misc_feature 1..1986: note = mRNA product Design h-1 comprising derived and/or modified sequence from HRSV(A2)__F_DSCav1_mut6 (opt1)
  source 1..1986: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaaccccgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6362 - RNA, 1986 nt, synthetic construct
  misc_feature 1..1986: note = mRNA product Design h-1 comprising derived and/or modified sequence from HRSV(A2)__F_DSCav1_mut6 (opt1)
  source 1..1986: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctcatgtgcagcacccccgccaccgggtccggcagcgccatcgcctccggcgtggcggtgtgcaaggtcctgcacctggagggggaggtgaacaagatcaagagcgccctcctgtccaccaacaaggccgtggtcagcctgtccaacggcgtgagcgtgctcacgttcaaggtcctggacctgaagaactacatcgacaagcagctcctgccgatcctgaacaagcagtcctgcagcatccccaaccccgagaccgtgatggagttccagcagaagaacaaccggctcctggagatcacccgcgagttctccgtgaacgccggggtcaccacgcccgtgagcacctacatgctgaccaactccgagctcctgagcctgatcaacgacatgccgatcaccaacgaccagaagaagctcatgagcaacaacgtgcagatcgtccggcagcagtcctacagcatcatgtgcatcatcaaggaggaggtgctggcctacgtggtccagctgcccctctacggcgtgatcgacacgccctgctggaagctgcacaccagccccctgtgcaccaccaacacgaaggaggggagcaacatctgcctcacccgcaccgaccggggctggtactgcgacaacgcgggctccgtgagcttcttcccgcaggccgagacctgcaaggtctgctccaaccgcgtgttctgcgacacgatgaacagcctgaccctgccctccgaggtcaacctctgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaacaaggggatcatcaagaccttctccaacggctgcgactacgtgagcaacaagggcgtcgacacggtgtccgtggggaacaccctgtactacgtcaacaagcaggagggccagagcctctacgtgaagggggagcccatcatcaacttctacgacccgctggtgttccccagcgacgagttcgacgcctccatcagccaggtcaacgagaagatcaaccagtccctggcgttcatccggaagtccgacgagctcctgcacaacgtgaacgccggcaagtccaccaccaacatcatgatcaccacgatcatcatcgtgatcatcgtcatcctgctcagcctgatcgccgtggggctgctcctgtactgcaaggcccgctccacccccgtgaccctgagcaaggaccagctgtccggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6363 - RNA, 1986 nt, synthetic construct
  misc_feature 1..1986: note = mRNA product Design h-1 comprising derived and/or modified sequence from HRSV(A2)__F_DSCav1_mut6 (opt2)
  source 1..1986: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6364 - RNA, 1986 nt, synthetic construct
  misc_feature 1..1986: note = mRNA product Design h-1 comprising derived and/or modified sequence from HRSV(A2)__F_DSCav1_mut6 (opt3)
  source 1..1986: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagatgcttatgtgttccacacccgccaccgggtctggatcggctatagcatcaggcgtggccgtctgcaaggtgctgcacttggagggtgaggttaacaaaatcaagagcgctctcctgagtacgaataaagccgtggtctccctgtctaacggggtgagcgtactcacttttaaggttttagatctgaagaattacattgacaaacagcttttgcctatcctgaacaagcaatcctgttcaattccaaatccggaaaccgtgatggagttccagcagaaaaacaataggctactcgaaatcacacgggagtttagtgtcaacgcgggagtgactacccccgtgagcacatatatgctgaccaattctgagcttctgtccttgataaacgatatgcctattacgaacgaccagaagaaactcatgtcaaataacgtccaaatcgttcgccagcagagctacagtattatgtgcatcatcaaggaagaggtgctggcatatgtagtgcagttaccactgtacggcgtcattgatactccctgttggaaactccatacatctcctctttgcaccactaatacaaaggaaggctccaacatatgtctgacccgaacggaccgtgggtggtactgcgataatgccggaagcgtgtcgttctttccacaagctgagacctgtaaggtttgctctaacagagtgttctgcgacacaatgaactccttgactctaccctcagaagtcaatctgtgtaatgtggatatctttaaccctaaatatgactgcaagattatgaccagtaaaacagatgtaagctcctctgttatcactagcctcggtgccatagtgtcatgttacggcaagaccaaatgcacagcaagtaataagaacaaggggattatcaaaaccttctccaatggatgtgactatgtcagcaacaagggcgtggacactgtctctgtgggtaatacgctgtactatgttaacaaacaggaggggcagtcactttacgtgaagggagagccaatcattaacttttatgatccgctggtattccccagtgacgaatttgatgctagcatctcccaagtcaatgagaaaattaaccagtctttggccttcataaggaagtcggacgaactcctgcacaatgtgaacgcgggcaagagcacaaccaatatcatgattactaccatcatcattgttataatcgtgattttactgtccctaatcgccgtcggcctcctgctttactgcaaagcacggtcaacacctgtgaccttgagtaaggatcagctgtctgggattaacaatatcgctttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6365 - RNA, 1986 nt, synthetic construct
  misc_feature 1..1986: note = mRNA product Design h-1 comprising derived and/or modified sequence from HRSV(A2)__F_DSCav1_mut6 (opt4)
  source 1..1986: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6366 - RNA, 1986 nt, synthetic construct
  misc_feature 1..1986: note = mRNA product Design h-1 comprising derived and/or modified sequence from HRSV(A2)__F_DSCav1_mut6 (opt5)
  source 1..1986: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagatgctgatgtgtagcacccccgccacaggatccggctctgctattgccagcggggtcgcggtgtgcaaggttctgcacctcgagggagaggtgaacaaaatcaagtccgccctgcttagcaccaataaagctgtcgtgtctctgtccaacggcgttagcgtgctcacatttaaggtcctggatcttaagaattacattgacaaacagctgctccctatcctgaacaagcaatcttgttccattccgaatcccgaaaccgtgatggagttccagcagaaaaacaatcggctgctcgaaatcacgcgcgagtttagcgtgaacgccggcgtcacaacccctgtttctacatatatgctgaccaattccgagcttctgagcctcattaacgatatgcccatcaccaacgaccagaagaaactgatgtccaataacgtgcaaatcgtgagacagcagtcttacagcattatgtgcatcattaaggaagaggtccttgcttatgtggttcagctgcctctctacggggtgatcgatacaccctgttggaaactgcatacgtcccctctgtgcaccacaaataccaaggaaggaagcaacatttgtctcacacggaccgaccgcggctggtactgcgataatgccgggtctgtctccttctttccgcaagcggagacgtgtaaggtgtgcagcaacagagttttctgcgacacaatgaactctctgacccttcccagcgaagtgaatctgtgtaatgtcgatatctttaaccctaaatatgactgcaagatcatgacctccaaaacagatgtgtctagctccgtcattaccagcctcggagccatcgtgtcttgttacggcaagacaaaatgcacggcttccaataagaacaaggggattatcaaaaccttcagcaatggatgtgactatgtttctaacaagggcgtggacacagtctccgtgggcaataccctgtactatgttaacaaacaggaggggcagagcctttacgtgaagggagagcccattatcaacttttatgatcctctggtcttcccctccgacgaatttgatgcctctatcagccaagtgaatgagaaaattaaccagtccctcgctttcatccggaagtctgacgaactgctgcacaatgtgaacgccggcaagagcacaaccaatattatgatcacgaccattatcattgttatcatcgtcattctcctgtcccttatcgccgtggggctgctcctgtactgcaaagctcgcagcacaccggtgaccctgtctaaggatcagctttccggaattaacaatatcgcgttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6367 - RNA, 1986 nt, synthetic construct
  misc_feature 1..1986: note = mRNA product Design h-1 comprising derived and/or modified sequence from HRSV(A2)__F_DSCav1_mut6 (opt6)
  source 1..1986: mol_type = other RNA
gggagacccgtgacccggaagttgtacggctacgcgactttccctcccacaaaccctcgcgcccttcctttcctacttgggcccggcagaaagcttaccatggaactattaatcttaaaagcaaatgctataaccacaatattaacagcagtaacattctgttttgcctccggacaaaacataacagaagaattttatcaatcaacatgctctgcagtatccaaaggttacttaggcgcactacgcactggatggtatacatcagtaataacaatagaactatcaaacataaaagaaaataaatgtaacggtactgacgcaaaagtgaaactaattaaacaagaactcgacaaatacaaaaatgctgtaacagacctacaaatgctaatgtgctcaacacccgcaaccggatcaggatcagccatagcctccggagtcgcagtatgcaaagtattacatcttgaaggagaagtaaataaaataaaatcagcattactatccacaaataaagccgtagtatcactatcaaacggtgtatccgtccttacattcaaagtattagatctaaaaaactacatagataaacaactactacccatcttaaacaaacaatcatgctcaattcccaacccagaaacagtcatggaatttcaacaaaaaaacaacagactcttagaaataacacgagaattttcagtaaacgcaggagtaaccacaccagtaagtacatacatgctcaccaactcagaattattatcacttattaacgacatgccaattacaaacgaccaaaaaaaattaatgtcaaacaatgtccaaattgttagacaacaatcatactctataatgtgtataataaaagaagaagtactagcttacgtagttcaattaccactatatggcgtaatagatacaccttgctggaaactacatacatctccattatgtacaactaacacaaaagaaggatctaacatatgcctaacacgcacagatcgaggatggtactgcgataatgcaggttccgtatcattctttccacaagcagaaacatgtaaagtatgctcaaacagagtattctgtgacactatgaactccttaaccctaccctcagaagtcaatctatgcaacgttgacatatttaacccaaaatacgactgtaaaatcatgacatctaaaacagacgtatcatcatcagttattacatccctaggagcaatagtatcttgctacggaaaaacaaaatgtacagcatccaacaaaaacaaaggaataatcaaaacattctcaaacggctgcgactacgtatcaaacaaaggtgtagacacagtatcagtaggaaatactttatattacgtaaataaacaagaaggacaatctctatacgttaaaggcgaacctattataaacttctacgacccactcgtattcccttcagacgaatttgacgcatctatatcccaagttaacgaaaaaatcaaccaatcattagcctttataagaaaatccgacgaattattacataacgtcaacgctggaaaatcaacaactaacataatgataaccacaataataatagtcatcatagttatattactaagtctaatagccgtaggcctcctactttattgcaaagcaagatcaacaccagtaacattatccaaagaccaactcagcggcataaacaatatagctttttcaaactagggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6368 - RNA, 1986 nt, synthetic construct
  misc_feature 1..1986: note = mRNA product Design h-1 comprising derived and/or modified sequence from HRSV(A2)__F_DSCav1_mut6 (opt11)
  source 1..1986: mol_type = other RNA
gggagacccgtgacccggaagttgtacggctacgcgactttccctcccacaaaccctcgcgcccttcctttcctacttgggcccggcagaaagcttaccatggaactcctcatcctcaaagccaacgcaatcacaaccatactaactgcagttactttctgcttcgcatccggccaaaacatcaccgaagagttctaccaatcaacctgctccgcagtctccaaaggatacctcggagcccttcgcaccggctggtacacctccgtcataaccatcgaactctcaaacataaaagaaaacaaatgcaacggcacagacgcgaaagtcaaacttatcaaacaagaactcgacaaatacaaaaacgccgtcaccgacctgcagatgctcatgtgctcaacccccgccacaggaagcggctctgctatcgcttccggcgtcgccgtctgcaaagtcctccacctcgaaggcgaagtaaacaaaatcaagtcagccctcctctccaccaacaaagccgtcgtctctctctcaaacggcgtatccgtcctcacattcaaagtcctcgacctcaaaaactacatcgacaaacaacttctccccatcctaaacaaacaatcatgctccatccccaaccccgaaacagtcatggaatttcaacaaaagaacaaccgcctcttagaaatcacccgagaattttccgtcaacgcgggagtcacaacccccgtttctacgtatatgctcaccaactccgaactcctttccctcataaacgacatgccaatcaccaacgaccaaaagaaactcatgtcaaacaacgtccaaatcgtccgacaacaatcctactctattatgtgcatcatcaaagaagaagttctcgcctacgtcgtccaactacccctctacggcgtgatcgacaccccctgctggaaactacacacctcacccctctgcaccaccaacaccaaggaaggctccaacatctgcctcacccgcaccgaccgcggctggtactgcgacaacgctggctccgtctcattcttcccgcaagccgaaacttgcaaagtatgctccaacagagtattctgcgacaccatgaactcactaaccctcccttccgaagtcaacctttgcaacgttgacatattcaacccaaagtacgattgcaaaattatgacatccaaaacagatgtctcctcctccgtcatcacatccctcggtgccattgtatcatgctacggaaaaaccaaatgcaccgcatccaacaaaaacaaaggaatcatcaaaaccttctcaaacggctgcgattacgtctcaaacaaaggagtcgacacagtctccgtcggaaacaccctatactacgtcaacaaacaagaaggccaatccctgtacgtcaaaggagaacccatcatcaacttctacgaccccctcgtcttcccgagcgacgagttcgacgcctccatctcacaagtcaatgaaaagatcaaccaatcccttgccttcatccggaaatcggacgaactcctacacaacgtgaacgctggaaaatcaaccaccaacatcatgatcacaaccatcattatcgtcatcatcgtcatactcctctccctaatcgccgtcggcctcctcctgtattgcaaagctcgctccacccccgtcaccctgtccaaagaccaactctccggaatcaacaacatcgccttctcaaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6369 - RNA, 2202 nt, synthetic construct
  misc_feature 1..2202: note = mRNA product Design h-2 comprising derived and/or modified sequence from HRSV(A2)__F_DSCav1_mut6 (opt1)
  source 1..2202: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaaccccgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6370 - RNA, 2202 nt, synthetic construct
  misc_feature 1..2202: note = mRNA product Design h-2 comprising derived and/or modified sequence from HRSV(A2)__F_DSCav1_mut6 (opt1)
  source 1..2202: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctcatgtgcagcacccccgccaccgggtccggcagcgccatcgcctccggcgtggcggtgtgcaaggtcctgcacctggagggggaggtgaacaagatcaagagcgccctcctgtccaccaacaaggccgtggtcagcctgtccaacggcgtgagcgtgctcacgttcaaggtcctggacctgaagaactacatcgacaagcagctcctgccgatcctgaacaagcagtcctgcagcatccccaaccccgagaccgtgatggagttccagcagaagaacaaccggctcctggagatcacccgcgagttctccgtgaacgccggggtcaccacgcccgtgagcacctacatgctgaccaactccgagctcctgagcctgatcaacgacatgccgatcaccaacgaccagaagaagctcatgagcaacaacgtgcagatcgtccggcagcagtcctacagcatcatgtgcatcatcaaggaggaggtgctggcctacgtggtccagctgcccctctacggcgtgatcgacacgccctgctggaagctgcacaccagccccctgtgcaccaccaacacgaaggaggggagcaacatctgcctcacccgcaccgaccggggctggtactgcgacaacgcgggctccgtgagcttcttcccgcaggccgagacctgcaaggtctgctccaaccgcgtgttctgcgacacgatgaacagcctgaccctgccctccgaggtcaacctctgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaacaaggggatcatcaagaccttctccaacggctgcgactacgtgagcaacaagggcgtcgacacggtgtccgtggggaacaccctgtactacgtcaacaagcaggagggccagagcctctacgtgaagggggagcccatcatcaacttctacgacccgctggtgttccccagcgacgagttcgacgcctccatcagccaggtcaacgagaagatcaaccagtccctggcgttcatccggaagtccgacgagctcctgcacaacgtgaacgccggcaagtccaccaccaacatcatgatcaccacgatcatcatcgtgatcatcgtcatcctgctcagcctgatcgccgtggggctgctcctgtactgcaaggcccgctccacccccgtgaccctgagcaaggaccagctgtccggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6371 - RNA, 2202 nt, synthetic construct
  misc_feature 1..2202: note = mRNA product Design h-2 comprising derived and/or modified sequence from HRSV(A2)__F_DSCav1_mut6 (opt2)
  source 1..2202: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6372 - RNA, 2202 nt, synthetic construct
  misc_feature 1..2202: note = mRNA product Design h-2 comprising derived and/or modified sequence from HRSV(A2)__F_DSCav1_mut6 (opt3)
  source 1..2202: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagatgcttatgtgttccacacccgccaccgggtctggatcggctatagcatcaggcgtggccgtctgcaaggtgctgcacttggagggtgaggttaacaaaatcaagagcgctctcctgagtacgaataaagccgtggtctccctgtctaacggggtgagcgtactcacttttaaggttttagatctgaagaattacattgacaaacagcttttgcctatcctgaacaagcaatcctgttcaattccaaatccggaaaccgtgatggagttccagcagaaaaacaataggctactcgaaatcacacgggagtttagtgtcaacgcgggagtgactacccccgtgagcacatatatgctgaccaattctgagcttctgtccttgataaacgatatgcctattacgaacgaccagaagaaactcatgtcaaataacgtccaaatcgttcgccagcagagctacagtattatgtgcatcatcaaggaagaggtgctggcatatgtagtgcagttaccactgtacggcgtcattgatactccctgttggaaactccatacatctcctctttgcaccactaatacaaaggaaggctccaacatatgtctgacccgaacggaccgtgggtggtactgcgataatgccggaagcgtgtcgttctttccacaagctgagacctgtaaggtttgctctaacagagtgttctgcgacacaatgaactccttgactctaccctcagaagtcaatctgtgtaatgtggatatctttaaccctaaatatgactgcaagattatgaccagtaaaacagatgtaagctcctctgttatcactagcctcggtgccatagtgtcatgttacggcaagaccaaatgcacagcaagtaataagaacaaggggattatcaaaaccttctccaatggatgtgactatgtcagcaacaagggcgtggacactgtctctgtgggtaatacgctgtactatgttaacaaacaggaggggcagtcactttacgtgaagggagagccaatcattaacttttatgatccgctggtattccccagtgacgaatttgatgctagcatctcccaagtcaatgagaaaattaaccagtctttggccttcataaggaagtcggacgaactcctgcacaatgtgaacgcgggcaagagcacaaccaatatcatgattactaccatcatcattgttataatcgtgattttactgtccctaatcgccgtcggcctcctgctttactgcaaagcacggtcaacacctgtgaccttgagtaaggatcagctgtctgggattaacaatatcgctttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6373 - RNA, 2202 nt, synthetic construct
  misc_feature 1..2202: note = mRNA product Design h-2 comprising derived and/or modified sequence from HRSV(A2)__F_DSCav1_mut6 (opt4)
  source 1..2202: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6374 - RNA, 2202 nt, synthetic construct
  misc_feature 1..2202: note = mRNA product Design h-2 comprising derived and/or modified sequence from HRSV(A2)__F_DSCav1_mut6 (opt5)
  source 1..2202: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagatgctgatgtgtagcacccccgccacaggatccggctctgctattgccagcggggtcgcggtgtgcaaggttctgcacctcgagggagaggtgaacaaaatcaagtccgccctgcttagcaccaataaagctgtcgtgtctctgtccaacggcgttagcgtgctcacatttaaggtcctggatcttaagaattacattgacaaacagctgctccctatcctgaacaagcaatcttgttccattccgaatcccgaaaccgtgatggagttccagcagaaaaacaatcggctgctcgaaatcacgcgcgagtttagcgtgaacgccggcgtcacaacccctgtttctacatatatgctgaccaattccgagcttctgagcctcattaacgatatgcccatcaccaacgaccagaagaaactgatgtccaataacgtgcaaatcgtgagacagcagtcttacagcattatgtgcatcattaaggaagaggtccttgcttatgtggttcagctgcctctctacggggtgatcgatacaccctgttggaaactgcatacgtcccctctgtgcaccacaaataccaaggaaggaagcaacatttgtctcacacggaccgaccgcggctggtactgcgataatgccgggtctgtctccttctttccgcaagcggagacgtgtaaggtgtgcagcaacagagttttctgcgacacaatgaactctctgacccttcccagcgaagtgaatctgtgtaatgtcgatatctttaaccctaaatatgactgcaagatcatgacctccaaaacagatgtgtctagctccgtcattaccagcctcggagccatcgtgtcttgttacggcaagacaaaatgcacggcttccaataagaacaaggggattatcaaaaccttcagcaatggatgtgactatgtttctaacaagggcgtggacacagtctccgtgggcaataccctgtactatgttaacaaacaggaggggcagagcctttacgtgaagggagagcccattatcaacttttatgatcctctggtcttcccctccgacgaatttgatgcctctatcagccaagtgaatgagaaaattaaccagtccctcgctttcatccggaagtctgacgaactgctgcacaatgtgaacgccggcaagagcacaaccaatattatgatcacgaccattatcattgttatcatcgtcattctcctgtcccttatcgccgtggggctgctcctgtactgcaaagctcgcagcacaccggtgaccctgtctaaggatcagctttccggaattaacaatatcgcgttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6375 - RNA, 2202 nt, synthetic construct
  misc_feature 1..2202: note = mRNA product Design h-2 comprising derived and/or modified sequence from HRSV(A2)__F_DSCav1_mut6 (opt6)
  source 1..2202: mol_type = other RNA
gggagacccgtgacccggaagttgtacggctacgcgactttccctcccacaaaccctcgcgcccttcctttcctacttgggcccggcagaaagcttaccatggaactattaatcttaaaagcaaatgctataaccacaatattaacagcagtaacattctgttttgcctccggacaaaacataacagaagaattttatcaatcaacatgctctgcagtatccaaaggttacttaggcgcactacgcactggatggtatacatcagtaataacaatagaactatcaaacataaaagaaaataaatgtaacggtactgacgcaaaagtgaaactaattaaacaagaactcgacaaatacaaaaatgctgtaacagacctacaaatgctaatgtgctcaacacccgcaaccggatcaggatcagccatagcctccggagtcgcagtatgcaaagtattacatcttgaaggagaagtaaataaaataaaatcagcattactatccacaaataaagccgtagtatcactatcaaacggtgtatccgtccttacattcaaagtattagatctaaaaaactacatagataaacaactactacccatcttaaacaaacaatcatgctcaattcccaacccagaaacagtcatggaatttcaacaaaaaaacaacagactcttagaaataacacgagaattttcagtaaacgcaggagtaaccacaccagtaagtacatacatgctcaccaactcagaattattatcacttattaacgacatgccaattacaaacgaccaaaaaaaattaatgtcaaacaatgtccaaattgttagacaacaatcatactctataatgtgtataataaaagaagaagtactagcttacgtagttcaattaccactatatggcgtaatagatacaccttgctggaaactacatacatctccattatgtacaactaacacaaaagaaggatctaacatatgcctaacacgcacagatcgaggatggtactgcgataatgcaggttccgtatcattctttccacaagcagaaacatgtaaagtatgctcaaacagagtattctgtgacactatgaactccttaaccctaccctcagaagtcaatctatgcaacgttgacatatttaacccaaaatacgactgtaaaatcatgacatctaaaacagacgtatcatcatcagttattacatccctaggagcaatagtatcttgctacggaaaaacaaaatgtacagcatccaacaaaaacaaaggaataatcaaaacattctcaaacggctgcgactacgtatcaaacaaaggtgtagacacagtatcagtaggaaatactttatattacgtaaataaacaagaaggacaatctctatacgttaaaggcgaacctattataaacttctacgacccactcgtattcccttcagacgaatttgacgcatctatatcccaagttaacgaaaaaatcaaccaatcattagcctttataagaaaatccgacgaattattacataacgtcaacgctggaaaatcaacaactaacataatgataaccacaataataatagtcatcatagttatattactaagtctaatagccgtaggcctcctactttattgcaaagcaagatcaacaccagtaacattatccaaagaccaactcagcggcataaacaatatagctttttcaaactagggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6376 - RNA, 2202 nt, synthetic construct
  misc_feature 1..2202: note = mRNA product Design h-2 comprising derived and/or modified sequence from HRSV(A2)__F_DSCav1_mut6 (opt11)
  source 1..2202: mol_type = other RNA
gggagacccgtgacccggaagttgtacggctacgcgactttccctcccacaaaccctcgcgcccttcctttcctacttgggcccggcagaaagcttaccatggaactcctcatcctcaaagccaacgcaatcacaaccatactaactgcagttactttctgcttcgcatccggccaaaacatcaccgaagagttctaccaatcaacctgctccgcagtctccaaaggatacctcggagcccttcgcaccggctggtacacctccgtcataaccatcgaactctcaaacataaaagaaaacaaatgcaacggcacagacgcgaaagtcaaacttatcaaacaagaactcgacaaatacaaaaacgccgtcaccgacctgcagatgctcatgtgctcaacccccgccacaggaagcggctctgctatcgcttccggcgtcgccgtctgcaaagtcctccacctcgaaggcgaagtaaacaaaatcaagtcagccctcctctccaccaacaaagccgtcgtctctctctcaaacggcgtatccgtcctcacattcaaagtcctcgacctcaaaaactacatcgacaaacaacttctccccatcctaaacaaacaatcatgctccatccccaaccccgaaacagtcatggaatttcaacaaaagaacaaccgcctcttagaaatcacccgagaattttccgtcaacgcgggagtcacaacccccgtttctacgtatatgctcaccaactccgaactcctttccctcataaacgacatgccaatcaccaacgaccaaaagaaactcatgtcaaacaacgtccaaatcgtccgacaacaatcctactctattatgtgcatcatcaaagaagaagttctcgcctacgtcgtccaactacccctctacggcgtgatcgacaccccctgctggaaactacacacctcacccctctgcaccaccaacaccaaggaaggctccaacatctgcctcacccgcaccgaccgcggctggtactgcgacaacgctggctccgtctcattcttcccgcaagccgaaacttgcaaagtatgctccaacagagtattctgcgacaccatgaactcactaaccctcccttccgaagtcaacctttgcaacgttgacatattcaacccaaagtacgattgcaaaattatgacatccaaaacagatgtctcctcctccgtcatcacatccctcggtgccattgtatcatgctacggaaaaaccaaatgcaccgcatccaacaaaaacaaaggaatcatcaaaaccttctcaaacggctgcgattacgtctcaaacaaaggagtcgacacagtctccgtcggaaacaccctatactacgtcaacaaacaagaaggccaatccctgtacgtcaaaggagaacccatcatcaacttctacgaccccctcgtcttcccgagcgacgagttcgacgcctccatctcacaagtcaatgaaaagatcaaccaatcccttgccttcatccggaaatcggacgaactcctacacaacgtgaacgctggaaaatcaaccaccaacatcatgatcacaaccatcattatcgtcatcatcgtcatactcctctccctaatcgccgtcggcctcctcctgtattgcaaagctcgctccacccccgtcaccctgtccaaagaccaactctccggaatcaacaacatcgccttctcaaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6377 - RNA, 1982 nt, synthetic construct
  misc_feature 1..1982: note = mRNA product Design h-3 comprising derived and/or modified sequence from HRSV(A2)__F_DSCav1_mut6 (opt1)
  source 1..1982: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaaccccgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6378 - RNA, 1982 nt, synthetic construct
  misc_feature 1..1982: note = mRNA product Design h-3 comprising derived and/or modified sequence from HRSV(A2)__F_DSCav1_mut6 (opt1)
  source 1..1982: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctcatgtgcagcacccccgccaccgggtccggcagcgccatcgcctccggcgtggcggtgtgcaaggtcctgcacctggagggggaggtgaacaagatcaagagcgccctcctgtccaccaacaaggccgtggtcagcctgtccaacggcgtgagcgtgctcacgttcaaggtcctggacctgaagaactacatcgacaagcagctcctgccgatcctgaacaagcagtcctgcagcatccccaaccccgagaccgtgatggagttccagcagaagaacaaccggctcctggagatcacccgcgagttctccgtgaacgccggggtcaccacgcccgtgagcacctacatgctgaccaactccgagctcctgagcctgatcaacgacatgccgatcaccaacgaccagaagaagctcatgagcaacaacgtgcagatcgtccggcagcagtcctacagcatcatgtgcatcatcaaggaggaggtgctggcctacgtggtccagctgcccctctacggcgtgatcgacacgccctgctggaagctgcacaccagccccctgtgcaccaccaacacgaaggaggggagcaacatctgcctcacccgcaccgaccggggctggtactgcgacaacgcgggctccgtgagcttcttcccgcaggccgagacctgcaaggtctgctccaaccgcgtgttctgcgacacgatgaacagcctgaccctgccctccgaggtcaacctctgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaacaaggggatcatcaagaccttctccaacggctgcgactacgtgagcaacaagggcgtcgacacggtgtccgtggggaacaccctgtactacgtcaacaagcaggagggccagagcctctacgtgaagggggagcccatcatcaacttctacgacccgctggtgttccccagcgacgagttcgacgcctccatcagccaggtcaacgagaagatcaaccagtccctggcgttcatccggaagtccgacgagctcctgcacaacgtgaacgccggcaagtccaccaccaacatcatgatcaccacgatcatcatcgtgatcatcgtcatcctgctcagcctgatcgccgtggggctgctcctgtactgcaaggcccgctccacccccgtgaccctgagcaaggaccagctgtccggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6379 - RNA, 1982 nt, synthetic construct
  misc_feature 1..1982: note = mRNA product Design h-3 comprising derived and/or modified sequence from HRSV(A2)__F_DSCav1_mut6 (opt2)
  source 1..1982: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6380 - RNA, 1982 nt, synthetic construct
  misc_feature 1..1982: note = mRNA product Design h-3 comprising derived and/or modified sequence from HRSV(A2)__F_DSCav1_mut6 (opt3)
  source 1..1982: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagatgcttatgtgttccacacccgccaccgggtctggatcggctatagcatcaggcgtggccgtctgcaaggtgctgcacttggagggtgaggttaacaaaatcaagagcgctctcctgagtacgaataaagccgtggtctccctgtctaacggggtgagcgtactcacttttaaggttttagatctgaagaattacattgacaaacagcttttgcctatcctgaacaagcaatcctgttcaattccaaatccggaaaccgtgatggagttccagcagaaaaacaataggctactcgaaatcacacgggagtttagtgtcaacgcgggagtgactacccccgtgagcacatatatgctgaccaattctgagcttctgtccttgataaacgatatgcctattacgaacgaccagaagaaactcatgtcaaataacgtccaaatcgttcgccagcagagctacagtattatgtgcatcatcaaggaagaggtgctggcatatgtagtgcagttaccactgtacggcgtcattgatactccctgttggaaactccatacatctcctctttgcaccactaatacaaaggaaggctccaacatatgtctgacccgaacggaccgtgggtggtactgcgataatgccggaagcgtgtcgttctttccacaagctgagacctgtaaggtttgctctaacagagtgttctgcgacacaatgaactccttgactctaccctcagaagtcaatctgtgtaatgtggatatctttaaccctaaatatgactgcaagattatgaccagtaaaacagatgtaagctcctctgttatcactagcctcggtgccatagtgtcatgttacggcaagaccaaatgcacagcaagtaataagaacaaggggattatcaaaaccttctccaatggatgtgactatgtcagcaacaagggcgtggacactgtctctgtgggtaatacgctgtactatgttaacaaacaggaggggcagtcactttacgtgaagggagagccaatcattaacttttatgatccgctggtattccccagtgacgaatttgatgctagcatctcccaagtcaatgagaaaattaaccagtctttggccttcataaggaagtcggacgaactcctgcacaatgtgaacgcgggcaagagcacaaccaatatcatgattactaccatcatcattgttataatcgtgattttactgtccctaatcgccgtcggcctcctgctttactgcaaagcacggtcaacacctgtgaccttgagtaaggatcagctgtctgggattaacaatatcgctttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6381 - RNA, 1982 nt, synthetic construct
  misc_feature 1..1982: note = mRNA product Design h-3 comprising derived and/or modified sequence from HRSV(A2)__F_DSCav1_mut6 (opt4)
  source 1..1982: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6382 - RNA, 1982 nt, synthetic construct
  misc_feature 1..1982: note = mRNA product Design h-3 comprising derived and/or modified sequence from HRSV(A2)__F_DSCav1_mut6 (opt5)
  source 1..1982: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagatgctgatgtgtagcacccccgccacaggatccggctctgctattgccagcggggtcgcggtgtgcaaggttctgcacctcgagggagaggtgaacaaaatcaagtccgccctgcttagcaccaataaagctgtcgtgtctctgtccaacggcgttagcgtgctcacatttaaggtcctggatcttaagaattacattgacaaacagctgctccctatcctgaacaagcaatcttgttccattccgaatcccgaaaccgtgatggagttccagcagaaaaacaatcggctgctcgaaatcacgcgcgagtttagcgtgaacgccggcgtcacaacccctgtttctacatatatgctgaccaattccgagcttctgagcctcattaacgatatgcccatcaccaacgaccagaagaaactgatgtccaataacgtgcaaatcgtgagacagcagtcttacagcattatgtgcatcattaaggaagaggtccttgcttatgtggttcagctgcctctctacggggtgatcgatacaccctgttggaaactgcatacgtcccctctgtgcaccacaaataccaaggaaggaagcaacatttgtctcacacggaccgaccgcggctggtactgcgataatgccgggtctgtctccttctttccgcaagcggagacgtgtaaggtgtgcagcaacagagttttctgcgacacaatgaactctctgacccttcccagcgaagtgaatctgtgtaatgtcgatatctttaaccctaaatatgactgcaagatcatgacctccaaaacagatgtgtctagctccgtcattaccagcctcggagccatcgtgtcttgttacggcaagacaaaatgcacggcttccaataagaacaaggggattatcaaaaccttcagcaatggatgtgactatgtttctaacaagggcgtggacacagtctccgtgggcaataccctgtactatgttaacaaacaggaggggcagagcctttacgtgaagggagagcccattatcaacttttatgatcctctggtcttcccctccgacgaatttgatgcctctatcagccaagtgaatgagaaaattaaccagtccctcgctttcatccggaagtctgacgaactgctgcacaatgtgaacgccggcaagagcacaaccaatattatgatcacgaccattatcattgttatcatcgtcattctcctgtcccttatcgccgtggggctgctcctgtactgcaaagctcgcagcacaccggtgaccctgtctaaggatcagctttccggaattaacaatatcgcgttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6383 - RNA, 1982 nt, synthetic construct
  misc_feature 1..1982: note = mRNA product Design h-3 comprising derived and/or modified sequence from HRSV(A2)__F_DSCav1_mut6 (opt6)
  source 1..1982: mol_type = other RNA
gggagacccgtgacccggaagttgtacggctacgcgactttccctcccacaaaccctcgcgcccttcctttcctacttgggcccggcagaaagcttaccatggaactattaatcttaaaagcaaatgctataaccacaatattaacagcagtaacattctgttttgcctccggacaaaacataacagaagaattttatcaatcaacatgctctgcagtatccaaaggttacttaggcgcactacgcactggatggtatacatcagtaataacaatagaactatcaaacataaaagaaaataaatgtaacggtactgacgcaaaagtgaaactaattaaacaagaactcgacaaatacaaaaatgctgtaacagacctacaaatgctaatgtgctcaacacccgcaaccggatcaggatcagccatagcctccggagtcgcagtatgcaaagtattacatcttgaaggagaagtaaataaaataaaatcagcattactatccacaaataaagccgtagtatcactatcaaacggtgtatccgtccttacattcaaagtattagatctaaaaaactacatagataaacaactactacccatcttaaacaaacaatcatgctcaattcccaacccagaaacagtcatggaatttcaacaaaaaaacaacagactcttagaaataacacgagaattttcagtaaacgcaggagtaaccacaccagtaagtacatacatgctcaccaactcagaattattatcacttattaacgacatgccaattacaaacgaccaaaaaaaattaatgtcaaacaatgtccaaattgttagacaacaatcatactctataatgtgtataataaaagaagaagtactagcttacgtagttcaattaccactatatggcgtaatagatacaccttgctggaaactacatacatctccattatgtacaactaacacaaaagaaggatctaacatatgcctaacacgcacagatcgaggatggtactgcgataatgcaggttccgtatcattctttccacaagcagaaacatgtaaagtatgctcaaacagagtattctgtgacactatgaactccttaaccctaccctcagaagtcaatctatgcaacgttgacatatttaacccaaaatacgactgtaaaatcatgacatctaaaacagacgtatcatcatcagttattacatccctaggagcaatagtatcttgctacggaaaaacaaaatgtacagcatccaacaaaaacaaaggaataatcaaaacattctcaaacggctgcgactacgtatcaaacaaaggtgtagacacagtatcagtaggaaatactttatattacgtaaataaacaagaaggacaatctctatacgttaaaggcgaacctattataaacttctacgacccactcgtattcccttcagacgaatttgacgcatctatatcccaagttaacgaaaaaatcaaccaatcattagcctttataagaaaatccgacgaattattacataacgtcaacgctggaaaatcaacaactaacataatgataaccacaataataatagtcatcatagttatattactaagtctaatagccgtaggcctcctactttattgcaaagcaagatcaacaccagtaacattatccaaagaccaactcagcggcataaacaatatagctttttcaaactagggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6384 - RNA, 1982 nt, synthetic construct
  misc_feature 1..1982: note = mRNA product Design h-3 comprising derived and/or modified sequence from HRSV(A2)__F_DSCav1_mut6 (opt11)
  source 1..1982: mol_type = other RNA
gggagacccgtgacccggaagttgtacggctacgcgactttccctcccacaaaccctcgcgcccttcctttcctacttgggcccggcagaaagcttaccatggaactcctcatcctcaaagccaacgcaatcacaaccatactaactgcagttactttctgcttcgcatccggccaaaacatcaccgaagagttctaccaatcaacctgctccgcagtctccaaaggatacctcggagcccttcgcaccggctggtacacctccgtcataaccatcgaactctcaaacataaaagaaaacaaatgcaacggcacagacgcgaaagtcaaacttatcaaacaagaactcgacaaatacaaaaacgccgtcaccgacctgcagatgctcatgtgctcaacccccgccacaggaagcggctctgctatcgcttccggcgtcgccgtctgcaaagtcctccacctcgaaggcgaagtaaacaaaatcaagtcagccctcctctccaccaacaaagccgtcgtctctctctcaaacggcgtatccgtcctcacattcaaagtcctcgacctcaaaaactacatcgacaaacaacttctccccatcctaaacaaacaatcatgctccatccccaaccccgaaacagtcatggaatttcaacaaaagaacaaccgcctcttagaaatcacccgagaattttccgtcaacgcgggagtcacaacccccgtttctacgtatatgctcaccaactccgaactcctttccctcataaacgacatgccaatcaccaacgaccaaaagaaactcatgtcaaacaacgtccaaatcgtccgacaacaatcctactctattatgtgcatcatcaaagaagaagttctcgcctacgtcgtccaactacccctctacggcgtgatcgacaccccctgctggaaactacacacctcacccctctgcaccaccaacaccaaggaaggctccaacatctgcctcacccgcaccgaccgcggctggtactgcgacaacgctggctccgtctcattcttcccgcaagccgaaacttgcaaagtatgctccaacagagtattctgcgacaccatgaactcactaaccctcccttccgaagtcaacctttgcaacgttgacatattcaacccaaagtacgattgcaaaattatgacatccaaaacagatgtctcctcctccgtcatcacatccctcggtgccattgtatcatgctacggaaaaaccaaatgcaccgcatccaacaaaaacaaaggaatcatcaaaaccttctcaaacggctgcgattacgtctcaaacaaaggagtcgacacagtctccgtcggaaacaccctatactacgtcaacaaacaagaaggccaatccctgtacgtcaaaggagaacccatcatcaacttctacgaccccctcgtcttcccgagcgacgagttcgacgcctccatctcacaagtcaatgaaaagatcaaccaatcccttgccttcatccggaaatcggacgaactcctacacaacgtgaacgctggaaaatcaaccaccaacatcatgatcacaaccatcattatcgtcatcatcgtcatactcctctccctaatcgccgtcggcctcctcctgtattgcaaagctcgctccacccccgtcaccctgtccaaagaccaactctccggaatcaacaacatcgccttctcaaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6385 - RNA, 2045 nt, synthetic construct
  misc_feature 1..2045: note = mRNA product Design h-4 comprising derived and/or modified sequence from HRSV(A2)__F_DSCav1_mut6 (opt1)
  source 1..2045: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaaccccgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6386 - RNA, 2045 nt, synthetic construct
  misc_feature 1..2045: note = mRNA product Design h-4 comprising derived and/or modified sequence from HRSV(A2)__F_DSCav1_mut6 (opt1)
  source 1..2045: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctcatgtgcagcacccccgccaccgggtccggcagcgccatcgcctccggcgtggcggtgtgcaaggtcctgcacctggagggggaggtgaacaagatcaagagcgccctcctgtccaccaacaaggccgtggtcagcctgtccaacggcgtgagcgtgctcacgttcaaggtcctggacctgaagaactacatcgacaagcagctcctgccgatcctgaacaagcagtcctgcagcatccccaaccccgagaccgtgatggagttccagcagaagaacaaccggctcctggagatcacccgcgagttctccgtgaacgccggggtcaccacgcccgtgagcacctacatgctgaccaactccgagctcctgagcctgatcaacgacatgccgatcaccaacgaccagaagaagctcatgagcaacaacgtgcagatcgtccggcagcagtcctacagcatcatgtgcatcatcaaggaggaggtgctggcctacgtggtccagctgcccctctacggcgtgatcgacacgccctgctggaagctgcacaccagccccctgtgcaccaccaacacgaaggaggggagcaacatctgcctcacccgcaccgaccggggctggtactgcgacaacgcgggctccgtgagcttcttcccgcaggccgagacctgcaaggtctgctccaaccgcgtgttctgcgacacgatgaacagcctgaccctgccctccgaggtcaacctctgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaacaaggggatcatcaagaccttctccaacggctgcgactacgtgagcaacaagggcgtcgacacggtgtccgtggggaacaccctgtactacgtcaacaagcaggagggccagagcctctacgtgaagggggagcccatcatcaacttctacgacccgctggtgttccccagcgacgagttcgacgcctccatcagccaggtcaacgagaagatcaaccagtccctggcgttcatccggaagtccgacgagctcctgcacaacgtgaacgccggcaagtccaccaccaacatcatgatcaccacgatcatcatcgtgatcatcgtcatcctgctcagcctgatcgccgtggggctgctcctgtactgcaaggcccgctccacccccgtgaccctgagcaaggaccagctgtccggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6387 - RNA, 2045 nt, synthetic construct
  misc_feature 1..2045: note = mRNA product Design h-4 comprising derived and/or modified sequence from HRSV(A2)__F_DSCav1_mut6 (opt2)
  source 1..2045: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6388 - RNA, 2045 nt, synthetic construct
  misc_feature 1..2045: note = mRNA product Design h-4 comprising derived and/or modified sequence from HRSV(A2)__F_DSCav1_mut6 (opt3)
  source 1..2045: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagatgcttatgtgttccacacccgccaccgggtctggatcggctatagcatcaggcgtggccgtctgcaaggtgctgcacttggagggtgaggttaacaaaatcaagagcgctctcctgagtacgaataaagccgtggtctccctgtctaacggggtgagcgtactcacttttaaggttttagatctgaagaattacattgacaaacagcttttgcctatcctgaacaagcaatcctgttcaattccaaatccggaaaccgtgatggagttccagcagaaaaacaataggctactcgaaatcacacgggagtttagtgtcaacgcgggagtgactacccccgtgagcacatatatgctgaccaattctgagcttctgtccttgataaacgatatgcctattacgaacgaccagaagaaactcatgtcaaataacgtccaaatcgttcgccagcagagctacagtattatgtgcatcatcaaggaagaggtgctggcatatgtagtgcagttaccactgtacggcgtcattgatactccctgttggaaactccatacatctcctctttgcaccactaatacaaaggaaggctccaacatatgtctgacccgaacggaccgtgggtggtactgcgataatgccggaagcgtgtcgttctttccacaagctgagacctgtaaggtttgctctaacagagtgttctgcgacacaatgaactccttgactctaccctcagaagtcaatctgtgtaatgtggatatctttaaccctaaatatgactgcaagattatgaccagtaaaacagatgtaagctcctctgttatcactagcctcggtgccatagtgtcatgttacggcaagaccaaatgcacagcaagtaataagaacaaggggattatcaaaaccttctccaatggatgtgactatgtcagcaacaagggcgtggacactgtctctgtgggtaatacgctgtactatgttaacaaacaggaggggcagtcactttacgtgaagggagagccaatcattaacttttatgatccgctggtattccccagtgacgaatttgatgctagcatctcccaagtcaatgagaaaattaaccagtctttggccttcataaggaagtcggacgaactcctgcacaatgtgaacgcgggcaagagcacaaccaatatcatgattactaccatcatcattgttataatcgtgattttactgtccctaatcgccgtcggcctcctgctttactgcaaagcacggtcaacacctgtgaccttgagtaaggatcagctgtctgggattaacaatatcgctttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6389 - RNA, 2045 nt, synthetic construct
  misc_feature 1..2045: note = mRNA product Design h-4 comprising derived and/or modified sequence from HRSV(A2)__F_DSCav1_mut6 (opt4)
  source 1..2045: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6390 - RNA, 2045 nt, synthetic construct
  misc_feature 1..2045: note = mRNA product Design h-4 comprising derived and/or modified sequence from HRSV(A2)__F_DSCav1_mut6 (opt5)
  source 1..2045: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagatgctgatgtgtagcacccccgccacaggatccggctctgctattgccagcggggtcgcggtgtgcaaggttctgcacctcgagggagaggtgaacaaaatcaagtccgccctgcttagcaccaataaagctgtcgtgtctctgtccaacggcgttagcgtgctcacatttaaggtcctggatcttaagaattacattgacaaacagctgctccctatcctgaacaagcaatcttgttccattccgaatcccgaaaccgtgatggagttccagcagaaaaacaatcggctgctcgaaatcacgcgcgagtttagcgtgaacgccggcgtcacaacccctgtttctacatatatgctgaccaattccgagcttctgagcctcattaacgatatgcccatcaccaacgaccagaagaaactgatgtccaataacgtgcaaatcgtgagacagcagtcttacagcattatgtgcatcattaaggaagaggtccttgcttatgtggttcagctgcctctctacggggtgatcgatacaccctgttggaaactgcatacgtcccctctgtgcaccacaaataccaaggaaggaagcaacatttgtctcacacggaccgaccgcggctggtactgcgataatgccgggtctgtctccttctttccgcaagcggagacgtgtaaggtgtgcagcaacagagttttctgcgacacaatgaactctctgacccttcccagcgaagtgaatctgtgtaatgtcgatatctttaaccctaaatatgactgcaagatcatgacctccaaaacagatgtgtctagctccgtcattaccagcctcggagccatcgtgtcttgttacggcaagacaaaatgcacggcttccaataagaacaaggggattatcaaaaccttcagcaatggatgtgactatgtttctaacaagggcgtggacacagtctccgtgggcaataccctgtactatgttaacaaacaggaggggcagagcctttacgtgaagggagagcccattatcaacttttatgatcctctggtcttcccctccgacgaatttgatgcctctatcagccaagtgaatgagaaaattaaccagtccctcgctttcatccggaagtctgacgaactgctgcacaatgtgaacgccggcaagagcacaaccaatattatgatcacgaccattatcattgttatcatcgtcattctcctgtcccttatcgccgtggggctgctcctgtactgcaaagctcgcagcacaccggtgaccctgtctaaggatcagctttccggaattaacaatatcgcgttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6391 - RNA, 2045 nt, synthetic construct
  misc_feature 1..2045: note = mRNA product Design h-4 comprising derived and/or modified sequence from HRSV(A2)__F_DSCav1_mut6 (opt6)
  source 1..2045: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactattaatcttaaaagcaaatgctataaccacaatattaacagcagtaacattctgttttgcctccggacaaaacataacagaagaattttatcaatcaacatgctctgcagtatccaaaggttacttaggcgcactacgcactggatggtatacatcagtaataacaatagaactatcaaacataaaagaaaataaatgtaacggtactgacgcaaaagtgaaactaattaaacaagaactcgacaaatacaaaaatgctgtaacagacctacaaatgctaatgtgctcaacacccgcaaccggatcaggatcagccatagcctccggagtcgcagtatgcaaagtattacatcttgaaggagaagtaaataaaataaaatcagcattactatccacaaataaagccgtagtatcactatcaaacggtgtatccgtccttacattcaaagtattagatctaaaaaactacatagataaacaactactacccatcttaaacaaacaatcatgctcaattcccaacccagaaacagtcatggaatttcaacaaaaaaacaacagactcttagaaataacacgagaattttcagtaaacgcaggagtaaccacaccagtaagtacatacatgctcaccaactcagaattattatcacttattaacgacatgccaattacaaacgaccaaaaaaaattaatgtcaaacaatgtccaaattgttagacaacaatcatactctataatgtgtataataaaagaagaagtactagcttacgtagttcaattaccactatatggcgtaatagatacaccttgctggaaactacatacatctccattatgtacaactaacacaaaagaaggatctaacatatgcctaacacgcacagatcgaggatggtactgcgataatgcaggttccgtatcattctttccacaagcagaaacatgtaaagtatgctcaaacagagtattctgtgacactatgaactccttaaccctaccctcagaagtcaatctatgcaacgttgacatatttaacccaaaatacgactgtaaaatcatgacatctaaaacagacgtatcatcatcagttattacatccctaggagcaatagtatcttgctacggaaaaacaaaatgtacagcatccaacaaaaacaaaggaataatcaaaacattctcaaacggctgcgactacgtatcaaacaaaggtgtagacacagtatcagtaggaaatactttatattacgtaaataaacaagaaggacaatctctatacgttaaaggcgaacctattataaacttctacgacccactcgtattcccttcagacgaatttgacgcatctatatcccaagttaacgaaaaaatcaaccaatcattagcctttataagaaaatccgacgaattattacataacgtcaacgctggaaaatcaacaactaacataatgataaccacaataataatagtcatcatagttatattactaagtctaatagccgtaggcctcctactttattgcaaagcaagatcaacaccagtaacattatccaaagaccaactcagcggcataaacaatatagctttttcaaactagggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6392 - RNA, 2045 nt, synthetic construct
  misc_feature 1..2045: note = mRNA product Design h-4 comprising derived and/or modified sequence from HRSV(A2)__F_DSCav1_mut6 (opt11)
  source 1..2045: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcctcatcctcaaagccaacgcaatcacaaccatactaactgcagttactttctgcttcgcatccggccaaaacatcaccgaagagttctaccaatcaacctgctccgcagtctccaaaggatacctcggagcccttcgcaccggctggtacacctccgtcataaccatcgaactctcaaacataaaagaaaacaaatgcaacggcacagacgcgaaagtcaaacttatcaaacaagaactcgacaaatacaaaaacgccgtcaccgacctgcagatgctcatgtgctcaacccccgccacaggaagcggctctgctatcgcttccggcgtcgccgtctgcaaagtcctccacctcgaaggcgaagtaaacaaaatcaagtcagccctcctctccaccaacaaagccgtcgtctctctctcaaacggcgtatccgtcctcacattcaaagtcctcgacctcaaaaactacatcgacaaacaacttctccccatcctaaacaaacaatcatgctccatccccaaccccgaaacagtcatggaatttcaacaaaagaacaaccgcctcttagaaatcacccgagaattttccgtcaacgcgggagtcacaacccccgtttctacgtatatgctcaccaactccgaactcctttccctcataaacgacatgccaatcaccaacgaccaaaagaaactcatgtcaaacaacgtccaaatcgtccgacaacaatcctactctattatgtgcatcatcaaagaagaagttctcgcctacgtcgtccaactacccctctacggcgtgatcgacaccccctgctggaaactacacacctcacccctctgcaccaccaacaccaaggaaggctccaacatctgcctcacccgcaccgaccgcggctggtactgcgacaacgctggctccgtctcattcttcccgcaagccgaaacttgcaaagtatgctccaacagagtattctgcgacaccatgaactcactaaccctcccttccgaagtcaacctttgcaacgttgacatattcaacccaaagtacgattgcaaaattatgacatccaaaacagatgtctcctcctccgtcatcacatccctcggtgccattgtatcatgctacggaaaaaccaaatgcaccgcatccaacaaaaacaaaggaatcatcaaaaccttctcaaacggctgcgattacgtctcaaacaaaggagtcgacacagtctccgtcggaaacaccctatactacgtcaacaaacaagaaggccaatccctgtacgtcaaaggagaacccatcatcaacttctacgaccccctcgtcttcccgagcgacgagttcgacgcctccatctcacaagtcaatgaaaagatcaaccaatcccttgccttcatccggaaatcggacgaactcctacacaacgtgaacgctggaaaatcaaccaccaacatcatgatcacaaccatcattatcgtcatcatcgtcatactcctctccctaatcgccgtcggcctcctcctgtattgcaaagctcgctccacccccgtcaccctgtccaaagaccaactctccggaatcaacaacatcgccttctcaaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6393 - RNA, 2061 nt, synthetic construct
  misc_feature 1..2061: note = mRNA product Design h-5 comprising derived and/or modified sequence from HRSV(A2)__F_DSCav1_mut6 (opt1)
  source 1..2061: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaaccccgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6394 - RNA, 2061 nt, synthetic construct
  misc_feature 1..2061: note = mRNA product Design h-5 comprising derived and/or modified sequence from HRSV(A2)__F_DSCav1_mut6 (opt1)
  source 1..2061: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctcatgtgcagcacccccgccaccgggtccggcagcgccatcgcctccggcgtggcggtgtgcaaggtcctgcacctggagggggaggtgaacaagatcaagagcgccctcctgtccaccaacaaggccgtggtcagcctgtccaacggcgtgagcgtgctcacgttcaaggtcctggacctgaagaactacatcgacaagcagctcctgccgatcctgaacaagcagtcctgcagcatccccaaccccgagaccgtgatggagttccagcagaagaacaaccggctcctggagatcacccgcgagttctccgtgaacgccggggtcaccacgcccgtgagcacctacatgctgaccaactccgagctcctgagcctgatcaacgacatgccgatcaccaacgaccagaagaagctcatgagcaacaacgtgcagatcgtccggcagcagtcctacagcatcatgtgcatcatcaaggaggaggtgctggcctacgtggtccagctgcccctctacggcgtgatcgacacgccctgctggaagctgcacaccagccccctgtgcaccaccaacacgaaggaggggagcaacatctgcctcacccgcaccgaccggggctggtactgcgacaacgcgggctccgtgagcttcttcccgcaggccgagacctgcaaggtctgctccaaccgcgtgttctgcgacacgatgaacagcctgaccctgccctccgaggtcaacctctgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaacaaggggatcatcaagaccttctccaacggctgcgactacgtgagcaacaagggcgtcgacacggtgtccgtggggaacaccctgtactacgtcaacaagcaggagggccagagcctctacgtgaagggggagcccatcatcaacttctacgacccgctggtgttccccagcgacgagttcgacgcctccatcagccaggtcaacgagaagatcaaccagtccctggcgttcatccggaagtccgacgagctcctgcacaacgtgaacgccggcaagtccaccaccaacatcatgatcaccacgatcatcatcgtgatcatcgtcatcctgctcagcctgatcgccgtggggctgctcctgtactgcaaggcccgctccacccccgtgaccctgagcaaggaccagctgtccggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6395 - RNA, 2061 nt, synthetic construct
  misc_feature 1..2061: note = mRNA product Design h-5 comprising derived and/or modified sequence from HRSV(A2)__F_DSCav1_mut6 (opt2)
  source 1..2061: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6396 - RNA, 2061 nt, synthetic construct
  misc_feature 1..2061: note = mRNA product Design h-5 comprising derived and/or modified sequence from HRSV(A2)__F_DSCav1_mut6 (opt3)
  source 1..2061: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagatgcttatgtgttccacacccgccaccgggtctggatcggctatagcatcaggcgtggccgtctgcaaggtgctgcacttggagggtgaggttaacaaaatcaagagcgctctcctgagtacgaataaagccgtggtctccctgtctaacggggtgagcgtactcacttttaaggttttagatctgaagaattacattgacaaacagcttttgcctatcctgaacaagcaatcctgttcaattccaaatccggaaaccgtgatggagttccagcagaaaaacaataggctactcgaaatcacacgggagtttagtgtcaacgcgggagtgactacccccgtgagcacatatatgctgaccaattctgagcttctgtccttgataaacgatatgcctattacgaacgaccagaagaaactcatgtcaaataacgtccaaatcgttcgccagcagagctacagtattatgtgcatcatcaaggaagaggtgctggcatatgtagtgcagttaccactgtacggcgtcattgatactccctgttggaaactccatacatctcctctttgcaccactaatacaaaggaaggctccaacatatgtctgacccgaacggaccgtgggtggtactgcgataatgccggaagcgtgtcgttctttccacaagctgagacctgtaaggtttgctctaacagagtgttctgcgacacaatgaactccttgactctaccctcagaagtcaatctgtgtaatgtggatatctttaaccctaaatatgactgcaagattatgaccagtaaaacagatgtaagctcctctgttatcactagcctcggtgccatagtgtcatgttacggcaagaccaaatgcacagcaagtaataagaacaaggggattatcaaaaccttctccaatggatgtgactatgtcagcaacaagggcgtggacactgtctctgtgggtaatacgctgtactatgttaacaaacaggaggggcagtcactttacgtgaagggagagccaatcattaacttttatgatccgctggtattccccagtgacgaatttgatgctagcatctcccaagtcaatgagaaaattaaccagtctttggccttcataaggaagtcggacgaactcctgcacaatgtgaacgcgggcaagagcacaaccaatatcatgattactaccatcatcattgttataatcgtgattttactgtccctaatcgccgtcggcctcctgctttactgcaaagcacggtcaacacctgtgaccttgagtaaggatcagctgtctgggattaacaatatcgctttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6397 - RNA, 2061 nt, synthetic construct
  misc_feature 1..2061: note = mRNA product Design h-5 comprising derived and/or modified sequence from HRSV(A2)__F_DSCav1_mut6 (opt4)
  source 1..2061: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6398 - RNA, 2061 nt, synthetic construct
  misc_feature 1..2061: note = mRNA product Design h-5 comprising derived and/or modified sequence from HRSV(A2)__F_DSCav1_mut6 (opt5)
  source 1..2061: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagatgctgatgtgtagcacccccgccacaggatccggctctgctattgccagcggggtcgcggtgtgcaaggttctgcacctcgagggagaggtgaacaaaatcaagtccgccctgcttagcaccaataaagctgtcgtgtctctgtccaacggcgttagcgtgctcacatttaaggtcctggatcttaagaattacattgacaaacagctgctccctatcctgaacaagcaatcttgttccattccgaatcccgaaaccgtgatggagttccagcagaaaaacaatcggctgctcgaaatcacgcgcgagtttagcgtgaacgccggcgtcacaacccctgtttctacatatatgctgaccaattccgagcttctgagcctcattaacgatatgcccatcaccaacgaccagaagaaactgatgtccaataacgtgcaaatcgtgagacagcagtcttacagcattatgtgcatcattaaggaagaggtccttgcttatgtggttcagctgcctctctacggggtgatcgatacaccctgttggaaactgcatacgtcccctctgtgcaccacaaataccaaggaaggaagcaacatttgtctcacacggaccgaccgcggctggtactgcgataatgccgggtctgtctccttctttccgcaagcggagacgtgtaaggtgtgcagcaacagagttttctgcgacacaatgaactctctgacccttcccagcgaagtgaatctgtgtaatgtcgatatctttaaccctaaatatgactgcaagatcatgacctccaaaacagatgtgtctagctccgtcattaccagcctcggagccatcgtgtcttgttacggcaagacaaaatgcacggcttccaataagaacaaggggattatcaaaaccttcagcaatggatgtgactatgtttctaacaagggcgtggacacagtctccgtgggcaataccctgtactatgttaacaaacaggaggggcagagcctttacgtgaagggagagcccattatcaacttttatgatcctctggtcttcccctccgacgaatttgatgcctctatcagccaagtgaatgagaaaattaaccagtccctcgctttcatccggaagtctgacgaactgctgcacaatgtgaacgccggcaagagcacaaccaatattatgatcacgaccattatcattgttatcatcgtcattctcctgtcccttatcgccgtggggctgctcctgtactgcaaagctcgcagcacaccggtgaccctgtctaaggatcagctttccggaattaacaatatcgcgttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6399 - RNA, 2061 nt, synthetic construct
  misc_feature 1..2061: note = mRNA product Design h-5 comprising derived and/or modified sequence from HRSV(A2)__F_DSCav1_mut6 (opt6)
  source 1..2061: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactattaatcttaaaagcaaatgctataaccacaatattaacagcagtaacattctgttttgcctccggacaaaacataacagaagaattttatcaatcaacatgctctgcagtatccaaaggttacttaggcgcactacgcactggatggtatacatcagtaataacaatagaactatcaaacataaaagaaaataaatgtaacggtactgacgcaaaagtgaaactaattaaacaagaactcgacaaatacaaaaatgctgtaacagacctacaaatgctaatgtgctcaacacccgcaaccggatcaggatcagccatagcctccggagtcgcagtatgcaaagtattacatcttgaaggagaagtaaataaaataaaatcagcattactatccacaaataaagccgtagtatcactatcaaacggtgtatccgtccttacattcaaagtattagatctaaaaaactacatagataaacaactactacccatcttaaacaaacaatcatgctcaattcccaacccagaaacagtcatggaatttcaacaaaaaaacaacagactcttagaaataacacgagaattttcagtaaacgcaggagtaaccacaccagtaagtacatacatgctcaccaactcagaattattatcacttattaacgacatgccaattacaaacgaccaaaaaaaattaatgtcaaacaatgtccaaattgttagacaacaatcatactctataatgtgtataataaaagaagaagtactagcttacgtagttcaattaccactatatggcgtaatagatacaccttgctggaaactacatacatctccattatgtacaactaacacaaaagaaggatctaacatatgcctaacacgcacagatcgaggatggtactgcgataatgcaggttccgtatcattctttccacaagcagaaacatgtaaagtatgctcaaacagagtattctgtgacactatgaactccttaaccctaccctcagaagtcaatctatgcaacgttgacatatttaacccaaaatacgactgtaaaatcatgacatctaaaacagacgtatcatcatcagttattacatccctaggagcaatagtatcttgctacggaaaaacaaaatgtacagcatccaacaaaaacaaaggaataatcaaaacattctcaaacggctgcgactacgtatcaaacaaaggtgtagacacagtatcagtaggaaatactttatattacgtaaataaacaagaaggacaatctctatacgttaaaggcgaacctattataaacttctacgacccactcgtattcccttcagacgaatttgacgcatctatatcccaagttaacgaaaaaatcaaccaatcattagcctttataagaaaatccgacgaattattacataacgtcaacgctggaaaatcaacaactaacataatgataaccacaataataatagtcatcatagttatattactaagtctaatagccgtaggcctcctactttattgcaaagcaagatcaacaccagtaacattatccaaagaccaactcagcggcataaacaatatagctttttcaaactagggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6400 - RNA, 2061 nt, synthetic construct
  misc_feature 1..2061: note = mRNA product Design h-5 comprising derived and/or modified sequence from HRSV(A2)__F_DSCav1_mut6 (opt11)
  source 1..2061: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcctcatcctcaaagccaacgcaatcacaaccatactaactgcagttactttctgcttcgcatccggccaaaacatcaccgaagagttctaccaatcaacctgctccgcagtctccaaaggatacctcggagcccttcgcaccggctggtacacctccgtcataaccatcgaactctcaaacataaaagaaaacaaatgcaacggcacagacgcgaaagtcaaacttatcaaacaagaactcgacaaatacaaaaacgccgtcaccgacctgcagatgctcatgtgctcaacccccgccacaggaagcggctctgctatcgcttccggcgtcgccgtctgcaaagtcctccacctcgaaggcgaagtaaacaaaatcaagtcagccctcctctccaccaacaaagccgtcgtctctctctcaaacggcgtatccgtcctcacattcaaagtcctcgacctcaaaaactacatcgacaaacaacttctccccatcctaaacaaacaatcatgctccatccccaaccccgaaacagtcatggaatttcaacaaaagaacaaccgcctcttagaaatcacccgagaattttccgtcaacgcgggagtcacaacccccgtttctacgtatatgctcaccaactccgaactcctttccctcataaacgacatgccaatcaccaacgaccaaaagaaactcatgtcaaacaacgtccaaatcgtccgacaacaatcctactctattatgtgcatcatcaaagaagaagttctcgcctacgtcgtccaactacccctctacggcgtgatcgacaccccctgctggaaactacacacctcacccctctgcaccaccaacaccaaggaaggctccaacatctgcctcacccgcaccgaccgcggctggtactgcgacaacgctggctccgtctcattcttcccgcaagccgaaacttgcaaagtatgctccaacagagtattctgcgacaccatgaactcactaaccctcccttccgaagtcaacctttgcaacgttgacatattcaacccaaagtacgattgcaaaattatgacatccaaaacagatgtctcctcctccgtcatcacatccctcggtgccattgtatcatgctacggaaaaaccaaatgcaccgcatccaacaaaaacaaaggaatcatcaaaaccttctcaaacggctgcgattacgtctcaaacaaaggagtcgacacagtctccgtcggaaacaccctatactacgtcaacaaacaagaaggccaatccctgtacgtcaaaggagaacccatcatcaacttctacgaccccctcgtcttcccgagcgacgagttcgacgcctccatctcacaagtcaatgaaaagatcaaccaatcccttgccttcatccggaaatcggacgaactcctacacaacgtgaacgctggaaaatcaaccaccaacatcatgatcacaaccatcattatcgtcatcatcgtcatactcctctccctaatcgccgtcggcctcctcctgtattgcaaagctcgctccacccccgtcaccctgtccaaagaccaactctccggaatcaacaacatcgccttctcaaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6401 - RNA, 1994 nt, synthetic construct
  misc_feature 1..1994: note = mRNA product Design i-1 comprising derived and/or modified sequence from HRSV(A2)__F_DSCav1_mut6 (opt1)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaaccccgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6402 - RNA, 1994 nt, synthetic construct
  misc_feature 1..1994: note = mRNA product Design i-1 comprising derived and/or modified sequence from HRSV(A2)__F_DSCav1_mut6 (opt1)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctcatgtgcagcacccccgccaccgggtccggcagcgccatcgcctccggcgtggcggtgtgcaaggtcctgcacctggagggggaggtgaacaagatcaagagcgccctcctgtccaccaacaaggccgtggtcagcctgtccaacggcgtgagcgtgctcacgttcaaggtcctggacctgaagaactacatcgacaagcagctcctgccgatcctgaacaagcagtcctgcagcatccccaaccccgagaccgtgatggagttccagcagaagaacaaccggctcctggagatcacccgcgagttctccgtgaacgccggggtcaccacgcccgtgagcacctacatgctgaccaactccgagctcctgagcctgatcaacgacatgccgatcaccaacgaccagaagaagctcatgagcaacaacgtgcagatcgtccggcagcagtcctacagcatcatgtgcatcatcaaggaggaggtgctggcctacgtggtccagctgcccctctacggcgtgatcgacacgccctgctggaagctgcacaccagccccctgtgcaccaccaacacgaaggaggggagcaacatctgcctcacccgcaccgaccggggctggtactgcgacaacgcgggctccgtgagcttcttcccgcaggccgagacctgcaaggtctgctccaaccgcgtgttctgcgacacgatgaacagcctgaccctgccctccgaggtcaacctctgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaacaaggggatcatcaagaccttctccaacggctgcgactacgtgagcaacaagggcgtcgacacggtgtccgtggggaacaccctgtactacgtcaacaagcaggagggccagagcctctacgtgaagggggagcccatcatcaacttctacgacccgctggtgttccccagcgacgagttcgacgcctccatcagccaggtcaacgagaagatcaaccagtccctggcgttcatccggaagtccgacgagctcctgcacaacgtgaacgccggcaagtccaccaccaacatcatgatcaccacgatcatcatcgtgatcatcgtcatcctgctcagcctgatcgccgtggggctgctcctgtactgcaaggcccgctccacccccgtgaccctgagcaaggaccagctgtccggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6403 - RNA, 1994 nt, synthetic construct
  misc_feature 1..1994: note = mRNA product Design i-1 comprising derived and/or modified sequence from HRSV(A2)__F_DSCav1_mut6 (opt2)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6404 - RNA, 1994 nt, synthetic construct
  misc_feature 1..1994: note = mRNA product Design i-1 comprising derived and/or modified sequence from HRSV(A2)__F_DSCav1_mut6 (opt3)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagatgcttatgtgttccacacccgccaccgggtctggatcggctatagcatcaggcgtggccgtctgcaaggtgctgcacttggagggtgaggttaacaaaatcaagagcgctctcctgagtacgaataaagccgtggtctccctgtctaacggggtgagcgtactcacttttaaggttttagatctgaagaattacattgacaaacagcttttgcctatcctgaacaagcaatcctgttcaattccaaatccggaaaccgtgatggagttccagcagaaaaacaataggctactcgaaatcacacgggagtttagtgtcaacgcgggagtgactacccccgtgagcacatatatgctgaccaattctgagcttctgtccttgataaacgatatgcctattacgaacgaccagaagaaactcatgtcaaataacgtccaaatcgttcgccagcagagctacagtattatgtgcatcatcaaggaagaggtgctggcatatgtagtgcagttaccactgtacggcgtcattgatactccctgttggaaactccatacatctcctctttgcaccactaatacaaaggaaggctccaacatatgtctgacccgaacggaccgtgggtggtactgcgataatgccggaagcgtgtcgttctttccacaagctgagacctgtaaggtttgctctaacagagtgttctgcgacacaatgaactccttgactctaccctcagaagtcaatctgtgtaatgtggatatctttaaccctaaatatgactgcaagattatgaccagtaaaacagatgtaagctcctctgttatcactagcctcggtgccatagtgtcatgttacggcaagaccaaatgcacagcaagtaataagaacaaggggattatcaaaaccttctccaatggatgtgactatgtcagcaacaagggcgtggacactgtctctgtgggtaatacgctgtactatgttaacaaacaggaggggcagtcactttacgtgaagggagagccaatcattaacttttatgatccgctggtattccccagtgacgaatttgatgctagcatctcccaagtcaatgagaaaattaaccagtctttggccttcataaggaagtcggacgaactcctgcacaatgtgaacgcgggcaagagcacaaccaatatcatgattactaccatcatcattgttataatcgtgattttactgtccctaatcgccgtcggcctcctgctttactgcaaagcacggtcaacacctgtgaccttgagtaaggatcagctgtctgggattaacaatatcgctttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6405 - RNA, 1994 nt, synthetic construct
  misc_feature 1..1994: note = mRNA product Design i-1 comprising derived and/or modified sequence from HRSV(A2)__F_DSCav1_mut6 (opt4)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6406 - RNA, 1994 nt, synthetic construct
  misc_feature 1..1994: note = mRNA product Design i-1 comprising derived and/or modified sequence from HRSV(A2)__F_DSCav1_mut6 (opt5)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagatgctgatgtgtagcacccccgccacaggatccggctctgctattgccagcggggtcgcggtgtgcaaggttctgcacctcgagggagaggtgaacaaaatcaagtccgccctgcttagcaccaataaagctgtcgtgtctctgtccaacggcgttagcgtgctcacatttaaggtcctggatcttaagaattacattgacaaacagctgctccctatcctgaacaagcaatcttgttccattccgaatcccgaaaccgtgatggagttccagcagaaaaacaatcggctgctcgaaatcacgcgcgagtttagcgtgaacgccggcgtcacaacccctgtttctacatatatgctgaccaattccgagcttctgagcctcattaacgatatgcccatcaccaacgaccagaagaaactgatgtccaataacgtgcaaatcgtgagacagcagtcttacagcattatgtgcatcattaaggaagaggtccttgcttatgtggttcagctgcctctctacggggtgatcgatacaccctgttggaaactgcatacgtcccctctgtgcaccacaaataccaaggaaggaagcaacatttgtctcacacggaccgaccgcggctggtactgcgataatgccgggtctgtctccttctttccgcaagcggagacgtgtaaggtgtgcagcaacagagttttctgcgacacaatgaactctctgacccttcccagcgaagtgaatctgtgtaatgtcgatatctttaaccctaaatatgactgcaagatcatgacctccaaaacagatgtgtctagctccgtcattaccagcctcggagccatcgtgtcttgttacggcaagacaaaatgcacggcttccaataagaacaaggggattatcaaaaccttcagcaatggatgtgactatgtttctaacaagggcgtggacacagtctccgtgggcaataccctgtactatgttaacaaacaggaggggcagagcctttacgtgaagggagagcccattatcaacttttatgatcctctggtcttcccctccgacgaatttgatgcctctatcagccaagtgaatgagaaaattaaccagtccctcgctttcatccggaagtctgacgaactgctgcacaatgtgaacgccggcaagagcacaaccaatattatgatcacgaccattatcattgttatcatcgtcattctcctgtcccttatcgccgtggggctgctcctgtactgcaaagctcgcagcacaccggtgaccctgtctaaggatcagctttccggaattaacaatatcgcgttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6407 - RNA, 1994 nt, synthetic construct
  misc_feature 1..1994: note = mRNA product Design i-1 comprising derived and/or modified sequence from HRSV(A2)__F_DSCav1_mut6 (opt6)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactattaatcttaaaagcaaatgctataaccacaatattaacagcagtaacattctgttttgcctccggacaaaacataacagaagaattttatcaatcaacatgctctgcagtatccaaaggttacttaggcgcactacgcactggatggtatacatcagtaataacaatagaactatcaaacataaaagaaaataaatgtaacggtactgacgcaaaagtgaaactaattaaacaagaactcgacaaatacaaaaatgctgtaacagacctacaaatgctaatgtgctcaacacccgcaaccggatcaggatcagccatagcctccggagtcgcagtatgcaaagtattacatcttgaaggagaagtaaataaaataaaatcagcattactatccacaaataaagccgtagtatcactatcaaacggtgtatccgtccttacattcaaagtattagatctaaaaaactacatagataaacaactactacccatcttaaacaaacaatcatgctcaattcccaacccagaaacagtcatggaatttcaacaaaaaaacaacagactcttagaaataacacgagaattttcagtaaacgcaggagtaaccacaccagtaagtacatacatgctcaccaactcagaattattatcacttattaacgacatgccaattacaaacgaccaaaaaaaattaatgtcaaacaatgtccaaattgttagacaacaatcatactctataatgtgtataataaaagaagaagtactagcttacgtagttcaattaccactatatggcgtaatagatacaccttgctggaaactacatacatctccattatgtacaactaacacaaaagaaggatctaacatatgcctaacacgcacagatcgaggatggtactgcgataatgcaggttccgtatcattctttccacaagcagaaacatgtaaagtatgctcaaacagagtattctgtgacactatgaactccttaaccctaccctcagaagtcaatctatgcaacgttgacatatttaacccaaaatacgactgtaaaatcatgacatctaaaacagacgtatcatcatcagttattacatccctaggagcaatagtatcttgctacggaaaaacaaaatgtacagcatccaacaaaaacaaaggaataatcaaaacattctcaaacggctgcgactacgtatcaaacaaaggtgtagacacagtatcagtaggaaatactttatattacgtaaataaacaagaaggacaatctctatacgttaaaggcgaacctattataaacttctacgacccactcgtattcccttcagacgaatttgacgcatctatatcccaagttaacgaaaaaatcaaccaatcattagcctttataagaaaatccgacgaattattacataacgtcaacgctggaaaatcaacaactaacataatgataaccacaataataatagtcatcatagttatattactaagtctaatagccgtaggcctcctactttattgcaaagcaagatcaacaccagtaacattatccaaagaccaactcagcggcataaacaatatagctttttcaaactagggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6408 - RNA, 1994 nt, synthetic construct
  misc_feature 1..1994: note = mRNA product Design i-1 comprising derived and/or modified sequence from HRSV(A2)__F_DSCav1_mut6 (opt11)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcctcatcctcaaagccaacgcaatcacaaccatactaactgcagttactttctgcttcgcatccggccaaaacatcaccgaagagttctaccaatcaacctgctccgcagtctccaaaggatacctcggagcccttcgcaccggctggtacacctccgtcataaccatcgaactctcaaacataaaagaaaacaaatgcaacggcacagacgcgaaagtcaaacttatcaaacaagaactcgacaaatacaaaaacgccgtcaccgacctgcagatgctcatgtgctcaacccccgccacaggaagcggctctgctatcgcttccggcgtcgccgtctgcaaagtcctccacctcgaaggcgaagtaaacaaaatcaagtcagccctcctctccaccaacaaagccgtcgtctctctctcaaacggcgtatccgtcctcacattcaaagtcctcgacctcaaaaactacatcgacaaacaacttctccccatcctaaacaaacaatcatgctccatccccaaccccgaaacagtcatggaatttcaacaaaagaacaaccgcctcttagaaatcacccgagaattttccgtcaacgcgggagtcacaacccccgtttctacgtatatgctcaccaactccgaactcctttccctcataaacgacatgccaatcaccaacgaccaaaagaaactcatgtcaaacaacgtccaaatcgtccgacaacaatcctactctattatgtgcatcatcaaagaagaagttctcgcctacgtcgtccaactacccctctacggcgtgatcgacaccccctgctggaaactacacacctcacccctctgcaccaccaacaccaaggaaggctccaacatctgcctcacccgcaccgaccgcggctggtactgcgacaacgctggctccgtctcattcttcccgcaagccgaaacttgcaaagtatgctccaacagagtattctgcgacaccatgaactcactaaccctcccttccgaagtcaacctttgcaacgttgacatattcaacccaaagtacgattgcaaaattatgacatccaaaacagatgtctcctcctccgtcatcacatccctcggtgccattgtatcatgctacggaaaaaccaaatgcaccgcatccaacaaaaacaaaggaatcatcaaaaccttctcaaacggctgcgattacgtctcaaacaaaggagtcgacacagtctccgtcggaaacaccctatactacgtcaacaaacaagaaggccaatccctgtacgtcaaaggagaacccatcatcaacttctacgaccccctcgtcttcccgagcgacgagttcgacgcctccatctcacaagtcaatgaaaagatcaaccaatcccttgccttcatccggaaatcggacgaactcctacacaacgtgaacgctggaaaatcaaccaccaacatcatgatcacaaccatcattatcgtcatcatcgtcatactcctctccctaatcgccgtcggcctcctcctgtattgcaaagctcgctccacccccgtcaccctgtccaaagaccaactctccggaatcaacaacatcgccttctcaaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6409 - RNA, 1994 nt, synthetic construct
  misc_feature 1..1994: note = mRNA product Design i-2 comprising derived and/or modified sequence from HRSV(A2)__F_DSCav1_mut6 (opt1)
  source 1..1994: mol_type = other RNA
gggagaggcgctgcctacggaggtggcagccatctccttctcggcatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaaccccgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6410 - RNA, 1994 nt, synthetic construct
  misc_feature 1..1994: note = mRNA product Design i-2 comprising derived and/or modified sequence from HRSV(A2)__F_DSCav1_mut6 (opt1)
  source 1..1994: mol_type = other RNA
gggagaggcgctgcctacggaggtggcagccatctccttctcggcatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctcatgtgcagcacccccgccaccgggtccggcagcgccatcgcctccggcgtggcggtgtgcaaggtcctgcacctggagggggaggtgaacaagatcaagagcgccctcctgtccaccaacaaggccgtggtcagcctgtccaacggcgtgagcgtgctcacgttcaaggtcctggacctgaagaactacatcgacaagcagctcctgccgatcctgaacaagcagtcctgcagcatccccaaccccgagaccgtgatggagttccagcagaagaacaaccggctcctggagatcacccgcgagttctccgtgaacgccggggtcaccacgcccgtgagcacctacatgctgaccaactccgagctcctgagcctgatcaacgacatgccgatcaccaacgaccagaagaagctcatgagcaacaacgtgcagatcgtccggcagcagtcctacagcatcatgtgcatcatcaaggaggaggtgctggcctacgtggtccagctgcccctctacggcgtgatcgacacgccctgctggaagctgcacaccagccccctgtgcaccaccaacacgaaggaggggagcaacatctgcctcacccgcaccgaccggggctggtactgcgacaacgcgggctccgtgagcttcttcccgcaggccgagacctgcaaggtctgctccaaccgcgtgttctgcgacacgatgaacagcctgaccctgccctccgaggtcaacctctgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaacaaggggatcatcaagaccttctccaacggctgcgactacgtgagcaacaagggcgtcgacacggtgtccgtggggaacaccctgtactacgtcaacaagcaggagggccagagcctctacgtgaagggggagcccatcatcaacttctacgacccgctggtgttccccagcgacgagttcgacgcctccatcagccaggtcaacgagaagatcaaccagtccctggcgttcatccggaagtccgacgagctcctgcacaacgtgaacgccggcaagtccaccaccaacatcatgatcaccacgatcatcatcgtgatcatcgtcatcctgctcagcctgatcgccgtggggctgctcctgtactgcaaggcccgctccacccccgtgaccctgagcaaggaccagctgtccggcatcaacaacatcgccttcagcaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6411 - RNA, 1994 nt, synthetic construct
  misc_feature 1..1994: note = mRNA product Design i-2 comprising derived and/or modified sequence from HRSV(A2)__F_DSCav1_mut6 (opt2)
  source 1..1994: mol_type = other RNA
gggagaggcgctgcctacggaggtggcagccatctccttctcggcatcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6412 - RNA, 1994 nt, synthetic construct
  misc_feature 1..1994: note = mRNA product Design i-2 comprising derived and/or modified sequence from HRSV(A2)__F_DSCav1_mut6 (opt3)
  source 1..1994: mol_type = other RNA
gggagaggcgctgcctacggaggtggcagccatctccttctcggcatcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagatgcttatgtgttccacacccgccaccgggtctggatcggctatagcatcaggcgtggccgtctgcaaggtgctgcacttggagggtgaggttaacaaaatcaagagcgctctcctgagtacgaataaagccgtggtctccctgtctaacggggtgagcgtactcacttttaaggttttagatctgaagaattacattgacaaacagcttttgcctatcctgaacaagcaatcctgttcaattccaaatccggaaaccgtgatggagttccagcagaaaaacaataggctactcgaaatcacacgggagtttagtgtcaacgcgggagtgactacccccgtgagcacatatatgctgaccaattctgagcttctgtccttgataaacgatatgcctattacgaacgaccagaagaaactcatgtcaaataacgtccaaatcgttcgccagcagagctacagtattatgtgcatcatcaaggaagaggtgctggcatatgtagtgcagttaccactgtacggcgtcattgatactccctgttggaaactccatacatctcctctttgcaccactaatacaaaggaaggctccaacatatgtctgacccgaacggaccgtgggtggtactgcgataatgccggaagcgtgtcgttctttccacaagctgagacctgtaaggtttgctctaacagagtgttctgcgacacaatgaactccttgactctaccctcagaagtcaatctgtgtaatgtggatatctttaaccctaaatatgactgcaagattatgaccagtaaaacagatgtaagctcctctgttatcactagcctcggtgccatagtgtcatgttacggcaagaccaaatgcacagcaagtaataagaacaaggggattatcaaaaccttctccaatggatgtgactatgtcagcaacaagggcgtggacactgtctctgtgggtaatacgctgtactatgttaacaaacaggaggggcagtcactttacgtgaagggagagccaatcattaacttttatgatccgctggtattccccagtgacgaatttgatgctagcatctcccaagtcaatgagaaaattaaccagtctttggccttcataaggaagtcggacgaactcctgcacaatgtgaacgcgggcaagagcacaaccaatatcatgattactaccatcatcattgttataatcgtgattttactgtccctaatcgccgtcggcctcctgctttactgcaaagcacggtcaacacctgtgaccttgagtaaggatcagctgtctgggattaacaatatcgctttcagcaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6413 - RNA, 1994 nt, synthetic construct
  misc_feature 1..1994: note = mRNA product Design i-2 comprising derived and/or modified sequence from HRSV(A2)__F_DSCav1_mut6 (opt4)
  source 1..1994: mol_type = other RNA
gggagaggcgctgcctacggaggtggcagccatctccttctcggcatcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6414 - RNA, 1994 nt, synthetic construct
  misc_feature 1..1994: note = mRNA product Design i-2 comprising derived and/or modified sequence from HRSV(A2)__F_DSCav1_mut6 (opt5)
  source 1..1994: mol_type = other RNA
gggagaggcgctgcctacggaggtggcagccatctccttctcggcatcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagatgctgatgtgtagcacccccgccacaggatccggctctgctattgccagcggggtcgcggtgtgcaaggttctgcacctcgagggagaggtgaacaaaatcaagtccgccctgcttagcaccaataaagctgtcgtgtctctgtccaacggcgttagcgtgctcacatttaaggtcctggatcttaagaattacattgacaaacagctgctccctatcctgaacaagcaatcttgttccattccgaatcccgaaaccgtgatggagttccagcagaaaaacaatcggctgctcgaaatcacgcgcgagtttagcgtgaacgccggcgtcacaacccctgtttctacatatatgctgaccaattccgagcttctgagcctcattaacgatatgcccatcaccaacgaccagaagaaactgatgtccaataacgtgcaaatcgtgagacagcagtcttacagcattatgtgcatcattaaggaagaggtccttgcttatgtggttcagctgcctctctacggggtgatcgatacaccctgttggaaactgcatacgtcccctctgtgcaccacaaataccaaggaaggaagcaacatttgtctcacacggaccgaccgcggctggtactgcgataatgccgggtctgtctccttctttccgcaagcggagacgtgtaaggtgtgcagcaacagagttttctgcgacacaatgaactctctgacccttcccagcgaagtgaatctgtgtaatgtcgatatctttaaccctaaatatgactgcaagatcatgacctccaaaacagatgtgtctagctccgtcattaccagcctcggagccatcgtgtcttgttacggcaagacaaaatgcacggcttccaataagaacaaggggattatcaaaaccttcagcaatggatgtgactatgtttctaacaagggcgtggacacagtctccgtgggcaataccctgtactatgttaacaaacaggaggggcagagcctttacgtgaagggagagcccattatcaacttttatgatcctctggtcttcccctccgacgaatttgatgcctctatcagccaagtgaatgagaaaattaaccagtccctcgctttcatccggaagtctgacgaactgctgcacaatgtgaacgccggcaagagcacaaccaatattatgatcacgaccattatcattgttatcatcgtcattctcctgtcccttatcgccgtggggctgctcctgtactgcaaagctcgcagcacaccggtgaccctgtctaaggatcagctttccggaattaacaatatcgcgttcagcaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6415 - RNA, 1994 nt, synthetic construct
  misc_feature 1..1994: note = mRNA product Design i-2 comprising derived and/or modified sequence from HRSV(A2)__F_DSCav1_mut6 (opt6)
  source 1..1994: mol_type = other RNA
gggagaggcgctgcctacggaggtggcagccatctccttctcggcatcaagcttaccatggaactattaatcttaaaagcaaatgctataaccacaatattaacagcagtaacattctgttttgcctccggacaaaacataacagaagaattttatcaatcaacatgctctgcagtatccaaaggttacttaggcgcactacgcactggatggtatacatcagtaataacaatagaactatcaaacataaaagaaaataaatgtaacggtactgacgcaaaagtgaaactaattaaacaagaactcgacaaatacaaaaatgctgtaacagacctacaaatgctaatgtgctcaacacccgcaaccggatcaggatcagccatagcctccggagtcgcagtatgcaaagtattacatcttgaaggagaagtaaataaaataaaatcagcattactatccacaaataaagccgtagtatcactatcaaacggtgtatccgtccttacattcaaagtattagatctaaaaaactacatagataaacaactactacccatcttaaacaaacaatcatgctcaattcccaacccagaaacagtcatggaatttcaacaaaaaaacaacagactcttagaaataacacgagaattttcagtaaacgcaggagtaaccacaccagtaagtacatacatgctcaccaactcagaattattatcacttattaacgacatgccaattacaaacgaccaaaaaaaattaatgtcaaacaatgtccaaattgttagacaacaatcatactctataatgtgtataataaaagaagaagtactagcttacgtagttcaattaccactatatggcgtaatagatacaccttgctggaaactacatacatctccattatgtacaactaacacaaaagaaggatctaacatatgcctaacacgcacagatcgaggatggtactgcgataatgcaggttccgtatcattctttccacaagcagaaacatgtaaagtatgctcaaacagagtattctgtgacactatgaactccttaaccctaccctcagaagtcaatctatgcaacgttgacatatttaacccaaaatacgactgtaaaatcatgacatctaaaacagacgtatcatcatcagttattacatccctaggagcaatagtatcttgctacggaaaaacaaaatgtacagcatccaacaaaaacaaaggaataatcaaaacattctcaaacggctgcgactacgtatcaaacaaaggtgtagacacagtatcagtaggaaatactttatattacgtaaataaacaagaaggacaatctctatacgttaaaggcgaacctattataaacttctacgacccactcgtattcccttcagacgaatttgacgcatctatatcccaagttaacgaaaaaatcaaccaatcattagcctttataagaaaatccgacgaattattacataacgtcaacgctggaaaatcaacaactaacataatgataaccacaataataatagtcatcatagttatattactaagtctaatagccgtaggcctcctactttattgcaaagcaagatcaacaccagtaacattatccaaagaccaactcagcggcataaacaatatagctttttcaaactagggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6416 - RNA, 1994 nt, synthetic construct
  misc_feature 1..1994: note = mRNA product Design i-2 comprising derived and/or modified sequence from HRSV(A2)__F_DSCav1_mut6 (opt11)
  source 1..1994: mol_type = other RNA
gggagaggcgctgcctacggaggtggcagccatctccttctcggcatcaagcttaccatggaactcctcatcctcaaagccaacgcaatcacaaccatactaactgcagttactttctgcttcgcatccggccaaaacatcaccgaagagttctaccaatcaacctgctccgcagtctccaaaggatacctcggagcccttcgcaccggctggtacacctccgtcataaccatcgaactctcaaacataaaagaaaacaaatgcaacggcacagacgcgaaagtcaaacttatcaaacaagaactcgacaaatacaaaaacgccgtcaccgacctgcagatgctcatgtgctcaacccccgccacaggaagcggctctgctatcgcttccggcgtcgccgtctgcaaagtcctccacctcgaaggcgaagtaaacaaaatcaagtcagccctcctctccaccaacaaagccgtcgtctctctctcaaacggcgtatccgtcctcacattcaaagtcctcgacctcaaaaactacatcgacaaacaacttctccccatcctaaacaaacaatcatgctccatccccaaccccgaaacagtcatggaatttcaacaaaagaacaaccgcctcttagaaatcacccgagaattttccgtcaacgcgggagtcacaacccccgtttctacgtatatgctcaccaactccgaactcctttccctcataaacgacatgccaatcaccaacgaccaaaagaaactcatgtcaaacaacgtccaaatcgtccgacaacaatcctactctattatgtgcatcatcaaagaagaagttctcgcctacgtcgtccaactacccctctacggcgtgatcgacaccccctgctggaaactacacacctcacccctctgcaccaccaacaccaaggaaggctccaacatctgcctcacccgcaccgaccgcggctggtactgcgacaacgctggctccgtctcattcttcccgcaagccgaaacttgcaaagtatgctccaacagagtattctgcgacaccatgaactcactaaccctcccttccgaagtcaacctttgcaacgttgacatattcaacccaaagtacgattgcaaaattatgacatccaaaacagatgtctcctcctccgtcatcacatccctcggtgccattgtatcatgctacggaaaaaccaaatgcaccgcatccaacaaaaacaaaggaatcatcaaaaccttctcaaacggctgcgattacgtctcaaacaaaggagtcgacacagtctccgtcggaaacaccctatactacgtcaacaaacaagaaggccaatccctgtacgtcaaaggagaacccatcatcaacttctacgaccccctcgtcttcccgagcgacgagttcgacgcctccatctcacaagtcaatgaaaagatcaaccaatcccttgccttcatccggaaatcggacgaactcctacacaacgtgaacgctggaaaatcaaccaccaacatcatgatcacaaccatcattatcgtcatcatcgtcatactcctctccctaatcgccgtcggcctcctcctgtattgcaaagctcgctccacccccgtcaccctgtccaaagaccaactctccggaatcaacaacatcgccttctcaaactaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6417 - RNA, 1990 nt, synthetic construct
  misc_feature 1..1990: note = mRNA product Design i-2 comprising derived and/or modified sequence from HRSV(A2)__F_DSCav1_mut6 (opt1)
  source 1..1990: mol_type = other RNA
ggggcgctgcctacggaggtggcagccatctccttctcggcatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaaccccgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6418 - RNA, 1990 nt, synthetic construct
  misc_feature 1..1990: note = mRNA product Design i-2 comprising derived and/or modified sequence from HRSV(A2)__F_DSCav1_mut6 (opt1)
  source 1..1990: mol_type = other RNA
ggggcgctgcctacggaggtggcagccatctccttctcggcatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctcatgtgcagcacccccgccaccgggtccggcagcgccatcgcctccggcgtggcggtgtgcaaggtcctgcacctggagggggaggtgaacaagatcaagagcgccctcctgtccaccaacaaggccgtggtcagcctgtccaacggcgtgagcgtgctcacgttcaaggtcctggacctgaagaactacatcgacaagcagctcctgccgatcctgaacaagcagtcctgcagcatccccaaccccgagaccgtgatggagttccagcagaagaacaaccggctcctggagatcacccgcgagttctccgtgaacgccggggtcaccacgcccgtgagcacctacatgctgaccaactccgagctcctgagcctgatcaacgacatgccgatcaccaacgaccagaagaagctcatgagcaacaacgtgcagatcgtccggcagcagtcctacagcatcatgtgcatcatcaaggaggaggtgctggcctacgtggtccagctgcccctctacggcgtgatcgacacgccctgctggaagctgcacaccagccccctgtgcaccaccaacacgaaggaggggagcaacatctgcctcacccgcaccgaccggggctggtactgcgacaacgcgggctccgtgagcttcttcccgcaggccgagacctgcaaggtctgctccaaccgcgtgttctgcgacacgatgaacagcctgaccctgccctccgaggtcaacctctgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaacaaggggatcatcaagaccttctccaacggctgcgactacgtgagcaacaagggcgtcgacacggtgtccgtggggaacaccctgtactacgtcaacaagcaggagggccagagcctctacgtgaagggggagcccatcatcaacttctacgacccgctggtgttccccagcgacgagttcgacgcctccatcagccaggtcaacgagaagatcaaccagtccctggcgttcatccggaagtccgacgagctcctgcacaacgtgaacgccggcaagtccaccaccaacatcatgatcaccacgatcatcatcgtgatcatcgtcatcctgctcagcctgatcgccgtggggctgctcctgtactgcaaggcccgctccacccccgtgaccctgagcaaggaccagctgtccggcatcaacaacatcgccttcagcaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6419 - RNA, 1990 nt, synthetic construct
  misc_feature 1..1990: note = mRNA product Design i-2 comprising derived and/or modified sequence from HRSV(A2)__F_DSCav1_mut6 (opt2)
  source 1..1990: mol_type = other RNA
ggggcgctgcctacggaggtggcagccatctccttctcggcatcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6420 - RNA, 1990 nt, synthetic construct
  misc_feature 1..1990: note = mRNA product Design i-2 comprising derived and/or modified sequence from HRSV(A2)__F_DSCav1_mut6 (opt3)
  source 1..1990: mol_type = other RNA
ggggcgctgcctacggaggtggcagccatctccttctcggcatcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagatgcttatgtgttccacacccgccaccgggtctggatcggctatagcatcaggcgtggccgtctgcaaggtgctgcacttggagggtgaggttaacaaaatcaagagcgctctcctgagtacgaataaagccgtggtctccctgtctaacggggtgagcgtactcacttttaaggttttagatctgaagaattacattgacaaacagcttttgcctatcctgaacaagcaatcctgttcaattccaaatccggaaaccgtgatggagttccagcagaaaaacaataggctactcgaaatcacacgggagtttagtgtcaacgcgggagtgactacccccgtgagcacatatatgctgaccaattctgagcttctgtccttgataaacgatatgcctattacgaacgaccagaagaaactcatgtcaaataacgtccaaatcgttcgccagcagagctacagtattatgtgcatcatcaaggaagaggtgctggcatatgtagtgcagttaccactgtacggcgtcattgatactccctgttggaaactccatacatctcctctttgcaccactaatacaaaggaaggctccaacatatgtctgacccgaacggaccgtgggtggtactgcgataatgccggaagcgtgtcgttctttccacaagctgagacctgtaaggtttgctctaacagagtgttctgcgacacaatgaactccttgactctaccctcagaagtcaatctgtgtaatgtggatatctttaaccctaaatatgactgcaagattatgaccagtaaaacagatgtaagctcctctgttatcactagcctcggtgccatagtgtcatgttacggcaagaccaaatgcacagcaagtaataagaacaaggggattatcaaaaccttctccaatggatgtgactatgtcagcaacaagggcgtggacactgtctctgtgggtaatacgctgtactatgttaacaaacaggaggggcagtcactttacgtgaagggagagccaatcattaacttttatgatccgctggtattccccagtgacgaatttgatgctagcatctcccaagtcaatgagaaaattaaccagtctttggccttcataaggaagtcggacgaactcctgcacaatgtgaacgcgggcaagagcacaaccaatatcatgattactaccatcatcattgttataatcgtgattttactgtccctaatcgccgtcggcctcctgctttactgcaaagcacggtcaacacctgtgaccttgagtaaggatcagctgtctgggattaacaatatcgctttcagcaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6421 - RNA, 1990 nt, synthetic construct
  misc_feature 1..1990: note = mRNA product Design i-2 comprising derived and/or modified sequence from HRSV(A2)__F_DSCav1_mut6 (opt4)
  source 1..1990: mol_type = other RNA
ggggcgctgcctacggaggtggcagccatctccttctcggcatcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6422 - RNA, 1990 nt, synthetic construct
  misc_feature 1..1990: note = mRNA product Design i-2 comprising derived and/or modified sequence from HRSV(A2)__F_DSCav1_mut6 (opt5)
  source 1..1990: mol_type = other RNA
ggggcgctgcctacggaggtggcagccatctccttctcggcatcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagatgctgatgtgtagcacccccgccacaggatccggctctgctattgccagcggggtcgcggtgtgcaaggttctgcacctcgagggagaggtgaacaaaatcaagtccgccctgcttagcaccaataaagctgtcgtgtctctgtccaacggcgttagcgtgctcacatttaaggtcctggatcttaagaattacattgacaaacagctgctccctatcctgaacaagcaatcttgttccattccgaatcccgaaaccgtgatggagttccagcagaaaaacaatcggctgctcgaaatcacgcgcgagtttagcgtgaacgccggcgtcacaacccctgtttctacatatatgctgaccaattccgagcttctgagcctcattaacgatatgcccatcaccaacgaccagaagaaactgatgtccaataacgtgcaaatcgtgagacagcagtcttacagcattatgtgcatcattaaggaagaggtccttgcttatgtggttcagctgcctctctacggggtgatcgatacaccctgttggaaactgcatacgtcccctctgtgcaccacaaataccaaggaaggaagcaacatttgtctcacacggaccgaccgcggctggtactgcgataatgccgggtctgtctccttctttccgcaagcggagacgtgtaaggtgtgcagcaacagagttttctgcgacacaatgaactctctgacccttcccagcgaagtgaatctgtgtaatgtcgatatctttaaccctaaatatgactgcaagatcatgacctccaaaacagatgtgtctagctccgtcattaccagcctcggagccatcgtgtcttgttacggcaagacaaaatgcacggcttccaataagaacaaggggattatcaaaaccttcagcaatggatgtgactatgtttctaacaagggcgtggacacagtctccgtgggcaataccctgtactatgttaacaaacaggaggggcagagcctttacgtgaagggagagcccattatcaacttttatgatcctctggtcttcccctccgacgaatttgatgcctctatcagccaagtgaatgagaaaattaaccagtccctcgctttcatccggaagtctgacgaactgctgcacaatgtgaacgccggcaagagcacaaccaatattatgatcacgaccattatcattgttatcatcgtcattctcctgtcccttatcgccgtggggctgctcctgtactgcaaagctcgcagcacaccggtgaccctgtctaaggatcagctttccggaattaacaatatcgcgttcagcaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6423 - RNA, 1990 nt, synthetic construct
  misc_feature 1..1990: note = mRNA product Design i-2 comprising derived and/or modified sequence from HRSV(A2)__F_DSCav1_mut6 (opt6)
  source 1..1990: mol_type = other RNA
ggggcgctgcctacggaggtggcagccatctccttctcggcatcaagcttaccatggaactattaatcttaaaagcaaatgctataaccacaatattaacagcagtaacattctgttttgcctccggacaaaacataacagaagaattttatcaatcaacatgctctgcagtatccaaaggttacttaggcgcactacgcactggatggtatacatcagtaataacaatagaactatcaaacataaaagaaaataaatgtaacggtactgacgcaaaagtgaaactaattaaacaagaactcgacaaatacaaaaatgctgtaacagacctacaaatgctaatgtgctcaacacccgcaaccggatcaggatcagccatagcctccggagtcgcagtatgcaaagtattacatcttgaaggagaagtaaataaaataaaatcagcattactatccacaaataaagccgtagtatcactatcaaacggtgtatccgtccttacattcaaagtattagatctaaaaaactacatagataaacaactactacccatcttaaacaaacaatcatgctcaattcccaacccagaaacagtcatggaatttcaacaaaaaaacaacagactcttagaaataacacgagaattttcagtaaacgcaggagtaaccacaccagtaagtacatacatgctcaccaactcagaattattatcacttattaacgacatgccaattacaaacgaccaaaaaaaattaatgtcaaacaatgtccaaattgttagacaacaatcatactctataatgtgtataataaaagaagaagtactagcttacgtagttcaattaccactatatggcgtaatagatacaccttgctggaaactacatacatctccattatgtacaactaacacaaaagaaggatctaacatatgcctaacacgcacagatcgaggatggtactgcgataatgcaggttccgtatcattctttccacaagcagaaacatgtaaagtatgctcaaacagagtattctgtgacactatgaactccttaaccctaccctcagaagtcaatctatgcaacgttgacatatttaacccaaaatacgactgtaaaatcatgacatctaaaacagacgtatcatcatcagttattacatccctaggagcaatagtatcttgctacggaaaaacaaaatgtacagcatccaacaaaaacaaaggaataatcaaaacattctcaaacggctgcgactacgtatcaaacaaaggtgtagacacagtatcagtaggaaatactttatattacgtaaataaacaagaaggacaatctctatacgttaaaggcgaacctattataaacttctacgacccactcgtattcccttcagacgaatttgacgcatctatatcccaagttaacgaaaaaatcaaccaatcattagcctttataagaaaatccgacgaattattacataacgtcaacgctggaaaatcaacaactaacataatgataaccacaataataatagtcatcatagttatattactaagtctaatagccgtaggcctcctactttattgcaaagcaagatcaacaccagtaacattatccaaagaccaactcagcggcataaacaatatagctttttcaaactagggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6424 - RNA, 1990 nt, synthetic construct
  misc_feature 1..1990: note = mRNA product Design i-2 comprising derived and/or modified sequence from HRSV(A2)__F_DSCav1_mut6 (opt11)
  source 1..1990: mol_type = other RNA
ggggcgctgcctacggaggtggcagccatctccttctcggcatcaagcttaccatggaactcctcatcctcaaagccaacgcaatcacaaccatactaactgcagttactttctgcttcgcatccggccaaaacatcaccgaagagttctaccaatcaacctgctccgcagtctccaaaggatacctcggagcccttcgcaccggctggtacacctccgtcataaccatcgaactctcaaacataaaagaaaacaaatgcaacggcacagacgcgaaagtcaaacttatcaaacaagaactcgacaaatacaaaaacgccgtcaccgacctgcagatgctcatgtgctcaacccccgccacaggaagcggctctgctatcgcttccggcgtcgccgtctgcaaagtcctccacctcgaaggcgaagtaaacaaaatcaagtcagccctcctctccaccaacaaagccgtcgtctctctctcaaacggcgtatccgtcctcacattcaaagtcctcgacctcaaaaactacatcgacaaacaacttctccccatcctaaacaaacaatcatgctccatccccaaccccgaaacagtcatggaatttcaacaaaagaacaaccgcctcttagaaatcacccgagaattttccgtcaacgcgggagtcacaacccccgtttctacgtatatgctcaccaactccgaactcctttccctcataaacgacatgccaatcaccaacgaccaaaagaaactcatgtcaaacaacgtccaaatcgtccgacaacaatcctactctattatgtgcatcatcaaagaagaagttctcgcctacgtcgtccaactacccctctacggcgtgatcgacaccccctgctggaaactacacacctcacccctctgcaccaccaacaccaaggaaggctccaacatctgcctcacccgcaccgaccgcggctggtactgcgacaacgctggctccgtctcattcttcccgcaagccgaaacttgcaaagtatgctccaacagagtattctgcgacaccatgaactcactaaccctcccttccgaagtcaacctttgcaacgttgacatattcaacccaaagtacgattgcaaaattatgacatccaaaacagatgtctcctcctccgtcatcacatccctcggtgccattgtatcatgctacggaaaaaccaaatgcaccgcatccaacaaaaacaaaggaatcatcaaaaccttctcaaacggctgcgattacgtctcaaacaaaggagtcgacacagtctccgtcggaaacaccctatactacgtcaacaaacaagaaggccaatccctgtacgtcaaaggagaacccatcatcaacttctacgaccccctcgtcttcccgagcgacgagttcgacgcctccatctcacaagtcaatgaaaagatcaaccaatcccttgccttcatccggaaatcggacgaactcctacacaacgtgaacgctggaaaatcaaccaccaacatcatgatcacaaccatcattatcgtcatcatcgtcatactcctctccctaatcgccgtcggcctcctcctgtattgcaaagctcgctccacccccgtcaccctgtccaaagaccaactctccggaatcaacaacatcgccttctcaaactaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6425 - RNA, 1825 nt, synthetic construct
  misc_feature 1..1825: note = mRNA product Design i-3 comprising derived and/or modified sequence from HRSV(A2)__F_DSCav1_mut6 (opt1)
  source 1..1825: mol_type = other RNA
gggagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaaccccgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6426 - RNA, 1825 nt, synthetic construct
  misc_feature 1..1825: note = mRNA product Design i-3 comprising derived and/or modified sequence from HRSV(A2)__F_DSCav1_mut6 (opt1)
  source 1..1825: mol_type = other RNA
gggagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctcatgtgcagcacccccgccaccgggtccggcagcgccatcgcctccggcgtggcggtgtgcaaggtcctgcacctggagggggaggtgaacaagatcaagagcgccctcctgtccaccaacaaggccgtggtcagcctgtccaacggcgtgagcgtgctcacgttcaaggtcctggacctgaagaactacatcgacaagcagctcctgccgatcctgaacaagcagtcctgcagcatccccaaccccgagaccgtgatggagttccagcagaagaacaaccggctcctggagatcacccgcgagttctccgtgaacgccggggtcaccacgcccgtgagcacctacatgctgaccaactccgagctcctgagcctgatcaacgacatgccgatcaccaacgaccagaagaagctcatgagcaacaacgtgcagatcgtccggcagcagtcctacagcatcatgtgcatcatcaaggaggaggtgctggcctacgtggtccagctgcccctctacggcgtgatcgacacgccctgctggaagctgcacaccagccccctgtgcaccaccaacacgaaggaggggagcaacatctgcctcacccgcaccgaccggggctggtactgcgacaacgcgggctccgtgagcttcttcccgcaggccgagacctgcaaggtctgctccaaccgcgtgttctgcgacacgatgaacagcctgaccctgccctccgaggtcaacctctgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaacaaggggatcatcaagaccttctccaacggctgcgactacgtgagcaacaagggcgtcgacacggtgtccgtggggaacaccctgtactacgtcaacaagcaggagggccagagcctctacgtgaagggggagcccatcatcaacttctacgacccgctggtgttccccagcgacgagttcgacgcctccatcagccaggtcaacgagaagatcaaccagtccctggcgttcatccggaagtccgacgagctcctgcacaacgtgaacgccggcaagtccaccaccaacatcatgatcaccacgatcatcatcgtgatcatcgtcatcctgctcagcctgatcgccgtggggctgctcctgtactgcaaggcccgctccacccccgtgaccctgagcaaggaccagctgtccggcatcaacaacatcgccttcagcaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6427 - RNA, 1825 nt, synthetic construct
  misc_feature 1..1825: note = mRNA product Design i-3 comprising derived and/or modified sequence from HRSV(A2)__F_DSCav1_mut6 (opt2)
  source 1..1825: mol_type = other RNA
gggagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6428 - RNA, 1825 nt, synthetic construct
  misc_feature 1..1825: note = mRNA product Design i-3 comprising derived and/or modified sequence from HRSV(A2)__F_DSCav1_mut6 (opt3)
  source 1..1825: mol_type = other RNA
gggagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagatgcttatgtgttccacacccgccaccgggtctggatcggctatagcatcaggcgtggccgtctgcaaggtgctgcacttggagggtgaggttaacaaaatcaagagcgctctcctgagtacgaataaagccgtggtctccctgtctaacggggtgagcgtactcacttttaaggttttagatctgaagaattacattgacaaacagcttttgcctatcctgaacaagcaatcctgttcaattccaaatccggaaaccgtgatggagttccagcagaaaaacaataggctactcgaaatcacacgggagtttagtgtcaacgcgggagtgactacccccgtgagcacatatatgctgaccaattctgagcttctgtccttgataaacgatatgcctattacgaacgaccagaagaaactcatgtcaaataacgtccaaatcgttcgccagcagagctacagtattatgtgcatcatcaaggaagaggtgctggcatatgtagtgcagttaccactgtacggcgtcattgatactccctgttggaaactccatacatctcctctttgcaccactaatacaaaggaaggctccaacatatgtctgacccgaacggaccgtgggtggtactgcgataatgccggaagcgtgtcgttctttccacaagctgagacctgtaaggtttgctctaacagagtgttctgcgacacaatgaactccttgactctaccctcagaagtcaatctgtgtaatgtggatatctttaaccctaaatatgactgcaagattatgaccagtaaaacagatgtaagctcctctgttatcactagcctcggtgccatagtgtcatgttacggcaagaccaaatgcacagcaagtaataagaacaaggggattatcaaaaccttctccaatggatgtgactatgtcagcaacaagggcgtggacactgtctctgtgggtaatacgctgtactatgttaacaaacaggaggggcagtcactttacgtgaagggagagccaatcattaacttttatgatccgctggtattccccagtgacgaatttgatgctagcatctcccaagtcaatgagaaaattaaccagtctttggccttcataaggaagtcggacgaactcctgcacaatgtgaacgcgggcaagagcacaaccaatatcatgattactaccatcatcattgttataatcgtgattttactgtccctaatcgccgtcggcctcctgctttactgcaaagcacggtcaacacctgtgaccttgagtaaggatcagctgtctgggattaacaatatcgctttcagcaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6429 - RNA, 1825 nt, synthetic construct
  misc_feature 1..1825: note = mRNA product Design i-3 comprising derived and/or modified sequence from HRSV(A2)__F_DSCav1_mut6 (opt4)
  source 1..1825: mol_type = other RNA
gggagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6430 - RNA, 1825 nt, synthetic construct
  misc_feature 1..1825: note = mRNA product Design i-3 comprising derived and/or modified sequence from HRSV(A2)__F_DSCav1_mut6 (opt5)
  source 1..1825: mol_type = other RNA
gggagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagatgctgatgtgtagcacccccgccacaggatccggctctgctattgccagcggggtcgcggtgtgcaaggttctgcacctcgagggagaggtgaacaaaatcaagtccgccctgcttagcaccaataaagctgtcgtgtctctgtccaacggcgttagcgtgctcacatttaaggtcctggatcttaagaattacattgacaaacagctgctccctatcctgaacaagcaatcttgttccattccgaatcccgaaaccgtgatggagttccagcagaaaaacaatcggctgctcgaaatcacgcgcgagtttagcgtgaacgccggcgtcacaacccctgtttctacatatatgctgaccaattccgagcttctgagcctcattaacgatatgcccatcaccaacgaccagaagaaactgatgtccaataacgtgcaaatcgtgagacagcagtcttacagcattatgtgcatcattaaggaagaggtccttgcttatgtggttcagctgcctctctacggggtgatcgatacaccctgttggaaactgcatacgtcccctctgtgcaccacaaataccaaggaaggaagcaacatttgtctcacacggaccgaccgcggctggtactgcgataatgccgggtctgtctccttctttccgcaagcggagacgtgtaaggtgtgcagcaacagagttttctgcgacacaatgaactctctgacccttcccagcgaagtgaatctgtgtaatgtcgatatctttaaccctaaatatgactgcaagatcatgacctccaaaacagatgtgtctagctccgtcattaccagcctcggagccatcgtgtcttgttacggcaagacaaaatgcacggcttccaataagaacaaggggattatcaaaaccttcagcaatggatgtgactatgtttctaacaagggcgtggacacagtctccgtgggcaataccctgtactatgttaacaaacaggaggggcagagcctttacgtgaagggagagcccattatcaacttttatgatcctctggtcttcccctccgacgaatttgatgcctctatcagccaagtgaatgagaaaattaaccagtccctcgctttcatccggaagtctgacgaactgctgcacaatgtgaacgccggcaagagcacaaccaatattatgatcacgaccattatcattgttatcatcgtcattctcctgtcccttatcgccgtggggctgctcctgtactgcaaagctcgcagcacaccggtgaccctgtctaaggatcagctttccggaattaacaatatcgcgttcagcaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6431 - RNA, 1825 nt, synthetic construct
  misc_feature 1..1825: note = mRNA product Design i-3 comprising derived and/or modified sequence from HRSV(A2)__F_DSCav1_mut6 (opt6)
  source 1..1825: mol_type = other RNA
gggagaaagcttaccatggaactattaatcttaaaagcaaatgctataaccacaatattaacagcagtaacattctgttttgcctccggacaaaacataacagaagaattttatcaatcaacatgctctgcagtatccaaaggttacttaggcgcactacgcactggatggtatacatcagtaataacaatagaactatcaaacataaaagaaaataaatgtaacggtactgacgcaaaagtgaaactaattaaacaagaactcgacaaatacaaaaatgctgtaacagacctacaaatgctaatgtgctcaacacccgcaaccggatcaggatcagccatagcctccggagtcgcagtatgcaaagtattacatcttgaaggagaagtaaataaaataaaatcagcattactatccacaaataaagccgtagtatcactatcaaacggtgtatccgtccttacattcaaagtattagatctaaaaaactacatagataaacaactactacccatcttaaacaaacaatcatgctcaattcccaacccagaaacagtcatggaatttcaacaaaaaaacaacagactcttagaaataacacgagaattttcagtaaacgcaggagtaaccacaccagtaagtacatacatgctcaccaactcagaattattatcacttattaacgacatgccaattacaaacgaccaaaaaaaattaatgtcaaacaatgtccaaattgttagacaacaatcatactctataatgtgtataataaaagaagaagtactagcttacgtagttcaattaccactatatggcgtaatagatacaccttgctggaaactacatacatctccattatgtacaactaacacaaaagaaggatctaacatatgcctaacacgcacagatcgaggatggtactgcgataatgcaggttccgtatcattctttccacaagcagaaacatgtaaagtatgctcaaacagagtattctgtgacactatgaactccttaaccctaccctcagaagtcaatctatgcaacgttgacatatttaacccaaaatacgactgtaaaatcatgacatctaaaacagacgtatcatcatcagttattacatccctaggagcaatagtatcttgctacggaaaaacaaaatgtacagcatccaacaaaaacaaaggaataatcaaaacattctcaaacggctgcgactacgtatcaaacaaaggtgtagacacagtatcagtaggaaatactttatattacgtaaataaacaagaaggacaatctctatacgttaaaggcgaacctattataaacttctacgacccactcgtattcccttcagacgaatttgacgcatctatatcccaagttaacgaaaaaatcaaccaatcattagcctttataagaaaatccgacgaattattacataacgtcaacgctggaaaatcaacaactaacataatgataaccacaataataatagtcatcatagttatattactaagtctaatagccgtaggcctcctactttattgcaaagcaagatcaacaccagtaacattatccaaagaccaactcagcggcataaacaatatagctttttcaaactagggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6432 - RNA, 1825 nt, synthetic construct
  misc_feature 1..1825: note = mRNA product Design i-3 comprising derived and/or modified sequence from HRSV(A2)__F_DSCav1_mut6 (opt11)
  source 1..1825: mol_type = other RNA
gggagaaagcttaccatggaactcctcatcctcaaagccaacgcaatcacaaccatactaactgcagttactttctgcttcgcatccggccaaaacatcaccgaagagttctaccaatcaacctgctccgcagtctccaaaggatacctcggagcccttcgcaccggctggtacacctccgtcataaccatcgaactctcaaacataaaagaaaacaaatgcaacggcacagacgcgaaagtcaaacttatcaaacaagaactcgacaaatacaaaaacgccgtcaccgacctgcagatgctcatgtgctcaacccccgccacaggaagcggctctgctatcgcttccggcgtcgccgtctgcaaagtcctccacctcgaaggcgaagtaaacaaaatcaagtcagccctcctctccaccaacaaagccgtcgtctctctctcaaacggcgtatccgtcctcacattcaaagtcctcgacctcaaaaactacatcgacaaacaacttctccccatcctaaacaaacaatcatgctccatccccaaccccgaaacagtcatggaatttcaacaaaagaacaaccgcctcttagaaatcacccgagaattttccgtcaacgcgggagtcacaacccccgtttctacgtatatgctcaccaactccgaactcctttccctcataaacgacatgccaatcaccaacgaccaaaagaaactcatgtcaaacaacgtccaaatcgtccgacaacaatcctactctattatgtgcatcatcaaagaagaagttctcgcctacgtcgtccaactacccctctacggcgtgatcgacaccccctgctggaaactacacacctcacccctctgcaccaccaacaccaaggaaggctccaacatctgcctcacccgcaccgaccgcggctggtactgcgacaacgctggctccgtctcattcttcccgcaagccgaaacttgcaaagtatgctccaacagagtattctgcgacaccatgaactcactaaccctcccttccgaagtcaacctttgcaacgttgacatattcaacccaaagtacgattgcaaaattatgacatccaaaacagatgtctcctcctccgtcatcacatccctcggtgccattgtatcatgctacggaaaaaccaaatgcaccgcatccaacaaaaacaaaggaatcatcaaaaccttctcaaacggctgcgattacgtctcaaacaaaggagtcgacacagtctccgtcggaaacaccctatactacgtcaacaaacaagaaggccaatccctgtacgtcaaaggagaacccatcatcaacttctacgaccccctcgtcttcccgagcgacgagttcgacgcctccatctcacaagtcaatgaaaagatcaaccaatcccttgccttcatccggaaatcggacgaactcctacacaacgtgaacgctggaaaatcaaccaccaacatcatgatcacaaccatcattatcgtcatcatcgtcatactcctctccctaatcgccgtcggcctcctcctgtattgcaaagctcgctccacccccgtcaccctgtccaaagaccaactctccggaatcaacaacatcgccttctcaaactaaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6433 - protein, 514 aa, synthetic construct
  REGION 1..514: note = derived and/or modified protein sequence (artificial) from HRSV(A2)__F-del_DSCav1_mut6
MELLILKANAITTILTAVTFCFASGQNITEEFYQSTCSAVSKGYLGALRTGWYTSVITIELSNIKENKCNGTDAKVKLIKQELDKYKNAVTDLQMLMCSTPATGSGSAIASGVAVCKVLHLEGEVNKIKSALLSTNKAVVSLSNGVSVLTFKVLDLKNYIDKQLLPILNKQSCSIPNPETVMEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVCSNRVFCDTMNSLTLPSEVNLCNVDIFNPKYDCKIMTSKTDVSSSVITSLGAIVSCYGKTKCTASNKNKGIIKTFSNGCDYVSNKGVDTVSVGNTLYYVNKQEGQSLYVKGEPIINFYDPLVFPSDEFDASISQVNEKINQSLAFIRKSDELLHNVNAGKSTTNIMITTIIIVIIVILLSLIAVGLLLYCKAR

SEQ ID NO: 6434 - RNA, 1545 nt, synthetic construct
  misc_feature 1..1545: note = derived and/or modified CDS sequence (opt1) from HRSV(A2)__F-del_DSCav1_mut6
  source 1..1545: mol_type = other RNA
atggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaaccccgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtga

SEQ ID NO: 6435 - RNA, 1545 nt, synthetic construct
  misc_feature 1..1545: note = derived and/or modified CDS sequence (opt1) from HRSV(A2)__F-del_DSCav1_mut6
  source 1..1545: mol_type = other RNA
atggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctcatgtgcagcacccccgccaccgggtccggcagcgccatcgcctccggcgtggcggtgtgcaaggtcctgcacctggagggggaggtgaacaagatcaagagcgccctcctgtccaccaacaaggccgtggtcagcctgtccaacggcgtgagcgtgctcacgttcaaggtcctggacctgaagaactacatcgacaagcagctcctgccgatcctgaacaagcagtcctgcagcatccccaaccccgagaccgtgatggagttccagcagaagaacaaccggctcctggagatcacccgcgagttctccgtgaacgccggggtcaccacgcccgtgagcacctacatgctgaccaactccgagctcctgagcctgatcaacgacatgccgatcaccaacgaccagaagaagctcatgagcaacaacgtgcagatcgtccggcagcagtcctacagcatcatgtgcatcatcaaggaggaggtgctggcctacgtggtccagctgcccctctacggcgtgatcgacacgccctgctggaagctgcacaccagccccctgtgcaccaccaacacgaaggaggggagcaacatctgcctcacccgcaccgaccggggctggtactgcgacaacgcgggctccgtgagcttcttcccgcaggccgagacctgcaaggtctgctccaaccgcgtgttctgcgacacgatgaacagcctgaccctgccctccgaggtcaacctctgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaacaaggggatcatcaagaccttctccaacggctgcgactacgtgagcaacaagggcgtcgacacggtgtccgtggggaacaccctgtactacgtcaacaagcaggagggccagagcctctacgtgaagggggagcccatcatcaacttctacgacccgctggtgttccccagcgacgagttcgacgcctccatcagccaggtcaacgagaagatcaaccagtccctggcgttcatccggaagtccgacgagctcctgcacaacgtgaacgccggcaagtccaccaccaacatcatgatcaccacgatcatcatcgtgatcatcgtcatcctgctcagcctgatcgccgtggggctgctcctgtactgcaaggcccgctga

SEQ ID NO: 6436 - RNA, 1545 nt, synthetic construct
  misc_feature 1..1545: note = derived and/or modified CDS sequence (opt2) from HRSV(A2)__F-del_DSCav1_mut6
  source 1..1545: mol_type = other RNA
atggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctga

SEQ ID NO: 6437 - RNA, 1545 nt, synthetic construct
  misc_feature 1..1545: note = derived and/or modified CDS sequence (opt3) from HRSV(A2)__F-del_DSCav1_mut6
  source 1..1545: mol_type = other RNA
atggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagatgcttatgtgttccacacccgccaccgggtctggatcggctatagcatcaggcgtggccgtctgcaaggtgctgcacttggagggtgaggttaacaaaatcaagagcgctctcctgagtacgaataaagccgtggtctccctgtctaacggggtgagcgtactcacttttaaggttttagatctgaagaattacattgacaaacagcttttgcctatcctgaacaagcaatcctgttcaattccaaatccggaaaccgtgatggagttccagcagaaaaacaataggctactcgaaatcacacgggagtttagtgtcaacgcgggagtgactacccccgtgagcacatatatgctgaccaattctgagcttctgtccttgataaacgatatgcctattacgaacgaccagaagaaactcatgtcaaataacgtccaaatcgttcgccagcagagctacagtattatgtgcatcatcaaggaagaggtgctggcatatgtagtgcagttaccactgtacggcgtcattgatactccctgttggaaactccatacatctcctctttgcaccactaatacaaaggaaggctccaacatatgtctgacccgaacggaccgtgggtggtactgcgataatgccggaagcgtgtcgttctttccacaagctgagacctgtaaggtttgctctaacagagtgttctgcgacacaatgaactccttgactctaccctcagaagtcaatctgtgtaatgtggatatctttaaccctaaatatgactgcaagattatgaccagtaaaacagatgtaagctcctctgttatcactagcctcggtgccatagtgtcatgttacggcaagaccaaatgcacagcaagtaataagaacaaggggattatcaaaaccttctccaatggatgtgactatgtcagcaacaagggcgtggacactgtctctgtgggtaatacgctgtactatgttaacaaacaggaggggcagtcactttacgtgaagggagagccaatcattaacttttatgatccgctggtattccccagtgacgaatttgatgctagcatctcccaagtcaatgagaaaattaaccagtctttggccttcataaggaagtcggacgaactcctgcacaatgtgaacgcgggcaagagcacaaccaatatcatgattactaccatcatcattgttataatcgtgattttactgtccctaatcgccgtcggcctcctgctttactgcaaagcacggtga

SEQ ID NO: 6438 - RNA, 1545 nt, synthetic construct
  misc_feature 1..1545: note = derived and/or modified CDS sequence (opt4) from HRSV(A2)__F-del_DSCav1_mut6
  source 1..1545: mol_type = other RNA
atggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatga

SEQ ID NO: 6439 - RNA, 1545 nt, synthetic construct
  misc_feature 1..1545: note = derived and/or modified CDS sequence (opt5) from HRSV(A2)__F-del_DSCav1_mut6
  source 1..1545: mol_type = other RNA
atggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagatgctgatgtgtagcacccccgccacaggatccggctctgctattgccagcggggtcgcggtgtgcaaggttctgcacctcgagggagaggtgaacaaaatcaagtccgccctgcttagcaccaataaagctgtcgtgtctctgtccaacggcgttagcgtgctcacatttaaggtcctggatcttaagaattacattgacaaacagctgctccctatcctgaacaagcaatcttgttccattccgaatcccgaaaccgtgatggagttccagcagaaaaacaatcggctgctcgaaatcacgcgcgagtttagcgtgaacgccggcgtcacaacccctgtttctacatatatgctgaccaattccgagcttctgagcctcattaacgatatgcccatcaccaacgaccagaagaaactgatgtccaataacgtgcaaatcgtgagacagcagtcttacagcattatgtgcatcattaaggaagaggtccttgcttatgtggttcagctgcctctctacggggtgatcgatacaccctgttggaaactgcatacgtcccctctgtgcaccacaaataccaaggaaggaagcaacatttgtctcacacggaccgaccgcggctggtactgcgataatgccgggtctgtctccttctttccgcaagcggagacgtgtaaggtgtgcagcaacagagttttctgcgacacaatgaactctctgacccttcccagcgaagtgaatctgtgtaatgtcgatatctttaaccctaaatatgactgcaagatcatgacctccaaaacagatgtgtctagctccgtcattaccagcctcggagccatcgtgtcttgttacggcaagacaaaatgcacggcttccaataagaacaaggggattatcaaaaccttcagcaatggatgtgactatgtttctaacaagggcgtggacacagtctccgtgggcaataccctgtactatgttaacaaacaggaggggcagagcctttacgtgaagggagagcccattatcaacttttatgatcctctggtcttcccctccgacgaatttgatgcctctatcagccaagtgaatgagaaaattaaccagtccctcgctttcatccggaagtctgacgaactgctgcacaatgtgaacgccggcaagagcacaaccaatattatgatcacgaccattatcattgttatcatcgtcattctcctgtcccttatcgccgtggggctgctcctgtactgcaaagctcgctga

SEQ ID NO: 6440 - RNA, 1545 nt, synthetic construct
  misc_feature 1..1545: note = derived and/or modified CDS sequence (opt6) from HRSV(A2)__F-del_DSCav1_mut6
  source 1..1545: mol_type = other RNA
atggaactactcatattaaaagcaaacgcaataacaacgatattaacagctgtaacattctgctttgcatcaggccaaaatatcaccgaagaattttatcaaagcacatgctctgcagtatccaaaggatacttaggagcattaagaacaggctggtacacatccgtaataacaatagaactatcaaacatcaaagaaaacaaatgcaacggcacagacgccaaagtaaaactcataaaacaagaactagacaaatataaaaacgcagtaacagatctacaaatgctcatgtgctccacaccagcaaccggatctggttcagccatagcatccggcgtagccgtctgcaaagtattacacctcgaaggagaagtaaacaaaataaaatctgccctattatctacaaataaagccgtagtaagtctaagtaacggagtatcagtactaacatttaaagtcctagacctgaaaaactatatcgacaaacaactattaccaatactaaacaaacaatcctgttccatccctaacccagaaacagttatggaatttcaacaaaaaaataaccgccttttagaaataactagagaattttcagtaaacgcaggagttacaacaccagtatcaacatacatgctaacaaattcagaattattatcccttataaatgacatgcctatcacaaacgatcaaaaaaaattaatgtccaacaacgtacaaatagtaagacaacaatcatattccatcatgtgcatcataaaagaagaagtcctcgcatacgtagtgcaactaccactatacggagtcatagatacaccctgttggaaacttcacacatctccactatgcacaacaaacacgaaagaaggatccaacatatgcctaacacgaacagacagaggatggtattgcgacaacgctggaagtgtgagcttcttccctcaagcagaaacttgcaaagtatgcagcaatcgtgtattctgcgacacaatgaactcattaacactcccaagcgaagtaaacctctgcaatgtagacatctttaatccaaaatacgattgtaaaataatgacttcaaaaacagacgtctcatcatctgtaataacatctttaggagcaatagtttcttgctacggtaaaacaaaatgcaccgcatccaacaaaaacaaaggaataataaaaacattctctaacggctgcgattacgtatctaacaaaggagttgacacagtctcagtaggaaacacactatactacgtaaacaaacaagaaggacaaagcctatacgtaaaaggagaaccaataataaacttctatgacccattagtatttccaagcgatgaatttgacgcttcaatatcacaagtcaatgaaaaaataaatcagagcttagcattcataagaaaatctgatgaactactacacaatgtaaatgcaggaaaatccactaccaacataatgattaccacaattataatagttatcatagtaatactattatcactaatagccgttggattactactatactgcaaagcaagataa

SEQ ID NO: 6441 - RNA, 1545 nt, synthetic construct
  misc_feature 1..1545: note = derived and/or modified CDS sequence (opt11) from HRSV(A2)__F-del_DSCav1_mut6
  source 1..1545: mol_type = other RNA
atggaactactcatcctaaaagcaaacgccatcaccaccatactaaccgccgtcaccttctgcttcgcctcgggacaaaacatcaccgaagagttctaccagtcaacgtgctccgccgtctcaaaaggctacctaggcgccctccgcaccgggtggtatacctccgtcataactatcgaactctctaacatcaaagaaaacaaatgtaacggcaccgacgccaaagtcaaactaatcaaacaagaactggacaaatacaaaaacgccgtcaccgacctacaaatgctcatgtgctccactccagccaccggctccggtagcgcaatcgcctcaggcgtagctgtatgcaaagtcctccacctagaaggcgaagtaaacaaaataaaatccgccctcctctcaaccaacaaggccgtcgtctcactctcaaacggcgtctccgtactcacctttaaagtcctagaccttaaaaactacatcgacaaacaactgctaccaatcctcaacaaacaatcatgcagcatcccaaacccggaaacagtcatggagttccaacagaaaaacaaccgactcctcgaaatcacccgcgagttctccgtcaacgccggagtcaccacacctgtaagcacatacatgcttactaattccgaactcctttcactaataaacgacatgccaataaccaacgaccaaaagaaactcatgtccaacaacgtacaaatcgtacgccaacaatcctactccatcatgtgcatcatcaaagaagaagtcctggcctatgtcgtacaactccccctttacggtgtcatcgacacaccctgctggaaactacacaccagccccctctgcacaacaaacaccaaagaaggctccaacatctgcctcacccgtaccgaccgaggctggtactgcgacaacgccggctccgtctccttcttcccccaagccgaaacctgcaaagtctgcagcaaccgcgtcttctgcgataccatgaactccctcacactcccatctgaagtcaacctctgcaacgtcgatattttcaatccaaaatacgactgcaaaatcatgactagcaaaaccgacgttagctcctccgtcatcacctccctcggcgccatagtttcatgctacggcaaaaccaaatgcaccgcctccaacaaaaacaaaggcatcataaaaaccttctccaacgggtgcgactacgtatctaataaaggagtcgacaccgtctcagtaggaaacaccctctactatgtcaacaaacaagaaggccaatcactatacgttaaaggcgaaccaatcatcaacttctacgacccactcgtcttccccagcgacgagtttgacgcctcaatctcgcaagtcaatgaaaagattaaccaatccctagccttcatccgaaaaagtgacgaactcctccacaacgttaacgccggcaaatctacaaccaacatcatgatcaccactataatcatcgtcatcatagtcatacttctcagcctcatcgcagtcggactcctcctttattgcaaggcacgataa

SEQ ID NO: 6442 - RNA, 1821 nt, synthetic construct
  misc_feature 1..1821: note = mRNA product Design a-1 comprising derived and/or modified sequence from HRSV(A2)__F-del_DSCav1_mut6 (opt1)
  source 1..1821: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaaccccgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6443 - RNA, 1821 nt, synthetic construct
  misc_feature 1..1821: note = mRNA product Design a-1 comprising derived and/or modified sequence from HRSV(A2)__F-del_DSCav1_mut6 (opt1)
  source 1..1821: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctcatgtgcagcacccccgccaccgggtccggcagcgccatcgcctccggcgtggcggtgtgcaaggtcctgcacctggagggggaggtgaacaagatcaagagcgccctcctgtccaccaacaaggccgtggtcagcctgtccaacggcgtgagcgtgctcacgttcaaggtcctggacctgaagaactacatcgacaagcagctcctgccgatcctgaacaagcagtcctgcagcatccccaaccccgagaccgtgatggagttccagcagaagaacaaccggctcctggagatcacccgcgagttctccgtgaacgccggggtcaccacgcccgtgagcacctacatgctgaccaactccgagctcctgagcctgatcaacgacatgccgatcaccaacgaccagaagaagctcatgagcaacaacgtgcagatcgtccggcagcagtcctacagcatcatgtgcatcatcaaggaggaggtgctggcctacgtggtccagctgcccctctacggcgtgatcgacacgccctgctggaagctgcacaccagccccctgtgcaccaccaacacgaaggaggggagcaacatctgcctcacccgcaccgaccggggctggtactgcgacaacgcgggctccgtgagcttcttcccgcaggccgagacctgcaaggtctgctccaaccgcgtgttctgcgacacgatgaacagcctgaccctgccctccgaggtcaacctctgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaacaaggggatcatcaagaccttctccaacggctgcgactacgtgagcaacaagggcgtcgacacggtgtccgtggggaacaccctgtactacgtcaacaagcaggagggccagagcctctacgtgaagggggagcccatcatcaacttctacgacccgctggtgttccccagcgacgagttcgacgcctccatcagccaggtcaacgagaagatcaaccagtccctggcgttcatccggaagtccgacgagctcctgcacaacgtgaacgccggcaagtccaccaccaacatcatgatcaccacgatcatcatcgtgatcatcgtcatcctgctcagcctgatcgccgtggggctgctcctgtactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6444 - RNA, 1821 nt, synthetic construct
  misc_feature 1..1821: note = mRNA product Design a-1 comprising derived and/or modified sequence from HRSV(A2)__F-del_DSCav1_mut6 (opt2)
  source 1..1821: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6445 - RNA, 1821 nt, synthetic construct
  misc_feature 1..1821: note = mRNA product Design a-1 comprising derived and/or modified sequence from HRSV(A2)__F-del_DSCav1_mut6 (opt3)
  source 1..1821: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagatgcttatgtgttccacacccgccaccgggtctggatcggctatagcatcaggcgtggccgtctgcaaggtgctgcacttggagggtgaggttaacaaaatcaagagcgctctcctgagtacgaataaagccgtggtctccctgtctaacggggtgagcgtactcacttttaaggttttagatctgaagaattacattgacaaacagcttttgcctatcctgaacaagcaatcctgttcaattccaaatccggaaaccgtgatggagttccagcagaaaaacaataggctactcgaaatcacacgggagtttagtgtcaacgcgggagtgactacccccgtgagcacatatatgctgaccaattctgagcttctgtccttgataaacgatatgcctattacgaacgaccagaagaaactcatgtcaaataacgtccaaatcgttcgccagcagagctacagtattatgtgcatcatcaaggaagaggtgctggcatatgtagtgcagttaccactgtacggcgtcattgatactccctgttggaaactccatacatctcctctttgcaccactaatacaaaggaaggctccaacatatgtctgacccgaacggaccgtgggtggtactgcgataatgccggaagcgtgtcgttctttccacaagctgagacctgtaaggtttgctctaacagagtgttctgcgacacaatgaactccttgactctaccctcagaagtcaatctgtgtaatgtggatatctttaaccctaaatatgactgcaagattatgaccagtaaaacagatgtaagctcctctgttatcactagcctcggtgccatagtgtcatgttacggcaagaccaaatgcacagcaagtaataagaacaaggggattatcaaaaccttctccaatggatgtgactatgtcagcaacaagggcgtggacactgtctctgtgggtaatacgctgtactatgttaacaaacaggaggggcagtcactttacgtgaagggagagccaatcattaacttttatgatccgctggtattccccagtgacgaatttgatgctagcatctcccaagtcaatgagaaaattaaccagtctttggccttcataaggaagtcggacgaactcctgcacaatgtgaacgcgggcaagagcacaaccaatatcatgattactaccatcatcattgttataatcgtgattttactgtccctaatcgccgtcggcctcctgctttactgcaaagcacggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6446 - RNA, 1821 nt, synthetic construct
  misc_feature 1..1821: note = mRNA product Design a-1 comprising derived and/or modified sequence from HRSV(A2)__F-del_DSCav1_mut6 (opt4)
  source 1..1821: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6447 - RNA, 1821 nt, synthetic construct
  misc_feature 1..1821: note = mRNA product Design a-1 comprising derived and/or modified sequence from HRSV(A2)__F-del_DSCav1_mut6 (opt5)
  source 1..1821: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagatgctgatgtgtagcacccccgccacaggatccggctctgctattgccagcggggtcgcggtgtgcaaggttctgcacctcgagggagaggtgaacaaaatcaagtccgccctgcttagcaccaataaagctgtcgtgtctctgtccaacggcgttagcgtgctcacatttaaggtcctggatcttaagaattacattgacaaacagctgctccctatcctgaacaagcaatcttgttccattccgaatcccgaaaccgtgatggagttccagcagaaaaacaatcggctgctcgaaatcacgcgcgagtttagcgtgaacgccggcgtcacaacccctgtttctacatatatgctgaccaattccgagcttctgagcctcattaacgatatgcccatcaccaacgaccagaagaaactgatgtccaataacgtgcaaatcgtgagacagcagtcttacagcattatgtgcatcattaaggaagaggtccttgcttatgtggttcagctgcctctctacggggtgatcgatacaccctgttggaaactgcatacgtcccctctgtgcaccacaaataccaaggaaggaagcaacatttgtctcacacggaccgaccgcggctggtactgcgataatgccgggtctgtctccttctttccgcaagcggagacgtgtaaggtgtgcagcaacagagttttctgcgacacaatgaactctctgacccttcccagcgaagtgaatctgtgtaatgtcgatatctttaaccctaaatatgactgcaagatcatgacctccaaaacagatgtgtctagctccgtcattaccagcctcggagccatcgtgtcttgttacggcaagacaaaatgcacggcttccaataagaacaaggggattatcaaaaccttcagcaatggatgtgactatgtttctaacaagggcgtggacacagtctccgtgggcaataccctgtactatgttaacaaacaggaggggcagagcctttacgtgaagggagagcccattatcaacttttatgatcctctggtcttcccctccgacgaatttgatgcctctatcagccaagtgaatgagaaaattaaccagtccctcgctttcatccggaagtctgacgaactgctgcacaatgtgaacgccggcaagagcacaaccaatattatgatcacgaccattatcattgttatcatcgtcattctcctgtcccttatcgccgtggggctgctcctgtactgcaaagctcgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6448 - RNA, 1821 nt, synthetic construct
  misc_feature 1..1821: note = mRNA product Design a-1 comprising derived and/or modified sequence from HRSV(A2)__F-del_DSCav1_mut6 (opt6)
  source 1..1821: mol_type = other RNA
gggagagtcccgcagtcggcgtccagcggctctgcttgttcgtgtgtgtgtcgttgcaggccttattcaagcttaccatggaactactcatattaaaagcaaacgcaataacaacgatattaacagctgtaacattctgctttgcatcaggccaaaatatcaccgaagaattttatcaaagcacatgctctgcagtatccaaaggatacttaggagcattaagaacaggctggtacacatccgtaataacaatagaactatcaaacatcaaagaaaacaaatgcaacggcacagacgccaaagtaaaactcataaaacaagaactagacaaatataaaaacgcagtaacagatctacaaatgctcatgtgctccacaccagcaaccggatctggttcagccatagcatccggcgtagccgtctgcaaagtattacacctcgaaggagaagtaaacaaaataaaatctgccctattatctacaaataaagccgtagtaagtctaagtaacggagtatcagtactaacatttaaagtcctagacctgaaaaactatatcgacaaacaactattaccaatactaaacaaacaatcctgttccatccctaacccagaaacagttatggaatttcaacaaaaaaataaccgccttttagaaataactagagaattttcagtaaacgcaggagttacaacaccagtatcaacatacatgctaacaaattcagaattattatcccttataaatgacatgcctatcacaaacgatcaaaaaaaattaatgtccaacaacgtacaaatagtaagacaacaatcatattccatcatgtgcatcataaaagaagaagtcctcgcatacgtagtgcaactaccactatacggagtcatagatacaccctgttggaaacttcacacatctccactatgcacaacaaacacgaaagaaggatccaacatatgcctaacacgaacagacagaggatggtattgcgacaacgctggaagtgtgagcttcttccctcaagcagaaacttgcaaagtatgcagcaatcgtgtattctgcgacacaatgaactcattaacactcccaagcgaagtaaacctctgcaatgtagacatctttaatccaaaatacgattgtaaaataatgacttcaaaaacagacgtctcatcatctgtaataacatctttaggagcaatagtttcttgctacggtaaaacaaaatgcaccgcatccaacaaaaacaaaggaataataaaaacattctctaacggctgcgattacgtatctaacaaaggagttgacacagtctcagtaggaaacacactatactacgtaaacaaacaagaaggacaaagcctatacgtaaaaggagaaccaataataaacttctatgacccattagtatttccaagcgatgaatttgacgcttcaatatcacaagtcaatgaaaaaataaatcagagcttagcattcataagaaaatctgatgaactactacacaatgtaaatgcaggaaaatccactaccaacataatgattaccacaattataatagttatcatagtaatactattatcactaatagccgttggattactactatactgcaaagcaagataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6449 - RNA, 1821 nt, synthetic construct
  misc_feature 1..1821: note = mRNA product Design a-1 comprising derived and/or modified sequence from HRSV(A2)__F-del_DSCav1_mut6 (opt11)
  source 1..1821: mol_type = other RNA
gggagagtcccgcagtcggcgtccagcggctctgcttgttcgtgtgtgtgtcgttgcaggccttattcaagcttaccatggaactactcatcctaaaagcaaacgccatcaccaccatactaaccgccgtcaccttctgcttcgcctcgggacaaaacatcaccgaagagttctaccagtcaacgtgctccgccgtctcaaaaggctacctaggcgccctccgcaccgggtggtatacctccgtcataactatcgaactctctaacatcaaagaaaacaaatgtaacggcaccgacgccaaagtcaaactaatcaaacaagaactggacaaatacaaaaacgccgtcaccgacctacaaatgctcatgtgctccactccagccaccggctccggtagcgcaatcgcctcaggcgtagctgtatgcaaagtcctccacctagaaggcgaagtaaacaaaataaaatccgccctcctctcaaccaacaaggccgtcgtctcactctcaaacggcgtctccgtactcacctttaaagtcctagaccttaaaaactacatcgacaaacaactgctaccaatcctcaacaaacaatcatgcagcatcccaaacccggaaacagtcatggagttccaacagaaaaacaaccgactcctcgaaatcacccgcgagttctccgtcaacgccggagtcaccacacctgtaagcacatacatgcttactaattccgaactcctttcactaataaacgacatgccaataaccaacgaccaaaagaaactcatgtccaacaacgtacaaatcgtacgccaacaatcctactccatcatgtgcatcatcaaagaagaagtcctggcctatgtcgtacaactccccctttacggtgtcatcgacacaccctgctggaaactacacaccagccccctctgcacaacaaacaccaaagaaggctccaacatctgcctcacccgtaccgaccgaggctggtactgcgacaacgccggctccgtctccttcttcccccaagccgaaacctgcaaagtctgcagcaaccgcgtcttctgcgataccatgaactccctcacactcccatctgaagtcaacctctgcaacgtcgatattttcaatccaaaatacgactgcaaaatcatgactagcaaaaccgacgttagctcctccgtcatcacctccctcggcgccatagtttcatgctacggcaaaaccaaatgcaccgcctccaacaaaaacaaaggcatcataaaaaccttctccaacgggtgcgactacgtatctaataaaggagtcgacaccgtctcagtaggaaacaccctctactatgtcaacaaacaagaaggccaatcactatacgttaaaggcgaaccaatcatcaacttctacgacccactcgtcttccccagcgacgagtttgacgcctcaatctcgcaagtcaatgaaaagattaaccaatccctagccttcatccgaaaaagtgacgaactcctccacaacgttaacgccggcaaatctacaaccaacatcatgatcaccactataatcatcgtcatcatagtcatacttctcagcctcatcgcagtcggactcctcctttattgcaaggcacgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6450 - RNA, 1840 nt, synthetic construct
  misc_feature 1..1840: note = mRNA product Design a-2 comprising derived and/or modified sequence from HRSV(A2)__F-del_DSCav1_mut6 (opt1)
  source 1..1840: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaaccccgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6451 - RNA, 1840 nt, synthetic construct
  misc_feature 1..1840: note = mRNA product Design a-2 comprising derived and/or modified sequence from HRSV(A2)__F-del_DSCav1_mut6 (opt1)
  source 1..1840: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctcatgtgcagcacccccgccaccgggtccggcagcgccatcgcctccggcgtggcggtgtgcaaggtcctgcacctggagggggaggtgaacaagatcaagagcgccctcctgtccaccaacaaggccgtggtcagcctgtccaacggcgtgagcgtgctcacgttcaaggtcctggacctgaagaactacatcgacaagcagctcctgccgatcctgaacaagcagtcctgcagcatccccaaccccgagaccgtgatggagttccagcagaagaacaaccggctcctggagatcacccgcgagttctccgtgaacgccggggtcaccacgcccgtgagcacctacatgctgaccaactccgagctcctgagcctgatcaacgacatgccgatcaccaacgaccagaagaagctcatgagcaacaacgtgcagatcgtccggcagcagtcctacagcatcatgtgcatcatcaaggaggaggtgctggcctacgtggtccagctgcccctctacggcgtgatcgacacgccctgctggaagctgcacaccagccccctgtgcaccaccaacacgaaggaggggagcaacatctgcctcacccgcaccgaccggggctggtactgcgacaacgcgggctccgtgagcttcttcccgcaggccgagacctgcaaggtctgctccaaccgcgtgttctgcgacacgatgaacagcctgaccctgccctccgaggtcaacctctgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaacaaggggatcatcaagaccttctccaacggctgcgactacgtgagcaacaagggcgtcgacacggtgtccgtggggaacaccctgtactacgtcaacaagcaggagggccagagcctctacgtgaagggggagcccatcatcaacttctacgacccgctggtgttccccagcgacgagttcgacgcctccatcagccaggtcaacgagaagatcaaccagtccctggcgttcatccggaagtccgacgagctcctgcacaacgtgaacgccggcaagtccaccaccaacatcatgatcaccacgatcatcatcgtgatcatcgtcatcctgctcagcctgatcgccgtggggctgctcctgtactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6452 - RNA, 1840 nt, synthetic construct
  misc_feature 1..1840: note = mRNA product Design a-2 comprising derived and/or modified sequence from HRSV(A2)__F-del_DSCav1_mut6 (opt2)
  source 1..1840: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6453 - RNA, 1840 nt, synthetic construct
  misc_feature 1..1840: note = mRNA product Design a-2 comprising derived and/or modified sequence from HRSV(A2)__F-del_DSCav1_mut6 (opt3)
  source 1..1840: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagatgcttatgtgttccacacccgccaccgggtctggatcggctatagcatcaggcgtggccgtctgcaaggtgctgcacttggagggtgaggttaacaaaatcaagagcgctctcctgagtacgaataaagccgtggtctccctgtctaacggggtgagcgtactcacttttaaggttttagatctgaagaattacattgacaaacagcttttgcctatcctgaacaagcaatcctgttcaattccaaatccggaaaccgtgatggagttccagcagaaaaacaataggctactcgaaatcacacgggagtttagtgtcaacgcgggagtgactacccccgtgagcacatatatgctgaccaattctgagcttctgtccttgataaacgatatgcctattacgaacgaccagaagaaactcatgtcaaataacgtccaaatcgttcgccagcagagctacagtattatgtgcatcatcaaggaagaggtgctggcatatgtagtgcagttaccactgtacggcgtcattgatactccctgttggaaactccatacatctcctctttgcaccactaatacaaaggaaggctccaacatatgtctgacccgaacggaccgtgggtggtactgcgataatgccggaagcgtgtcgttctttccacaagctgagacctgtaaggtttgctctaacagagtgttctgcgacacaatgaactccttgactctaccctcagaagtcaatctgtgtaatgtggatatctttaaccctaaatatgactgcaagattatgaccagtaaaacagatgtaagctcctctgttatcactagcctcggtgccatagtgtcatgttacggcaagaccaaatgcacagcaagtaataagaacaaggggattatcaaaaccttctccaatggatgtgactatgtcagcaacaagggcgtggacactgtctctgtgggtaatacgctgtactatgttaacaaacaggaggggcagtcactttacgtgaagggagagccaatcattaacttttatgatccgctggtattccccagtgacgaatttgatgctagcatctcccaagtcaatgagaaaattaaccagtctttggccttcataaggaagtcggacgaactcctgcacaatgtgaacgcgggcaagagcacaaccaatatcatgattactaccatcatcattgttataatcgtgattttactgtccctaatcgccgtcggcctcctgctttactgcaaagcacggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6454 - RNA, 1840 nt, synthetic construct
  misc_feature 1..1840: note = mRNA product Design a-2 comprising derived and/or modified sequence from HRSV(A2)__F-del_DSCav1_mut6 (opt4)
  source 1..1840: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6455 - RNA, 1840 nt, synthetic construct
  misc_feature 1..1840: note = mRNA product Design a-2 comprising derived and/or modified sequence from HRSV(A2)__F-del_DSCav1_mut6 (opt5)
  source 1..1840: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagatgctgatgtgtagcacccccgccacaggatccggctctgctattgccagcggggtcgcggtgtgcaaggttctgcacctcgagggagaggtgaacaaaatcaagtccgccctgcttagcaccaataaagctgtcgtgtctctgtccaacggcgttagcgtgctcacatttaaggtcctggatcttaagaattacattgacaaacagctgctccctatcctgaacaagcaatcttgttccattccgaatcccgaaaccgtgatggagttccagcagaaaaacaatcggctgctcgaaatcacgcgcgagtttagcgtgaacgccggcgtcacaacccctgtttctacatatatgctgaccaattccgagcttctgagcctcattaacgatatgcccatcaccaacgaccagaagaaactgatgtccaataacgtgcaaatcgtgagacagcagtcttacagcattatgtgcatcattaaggaagaggtccttgcttatgtggttcagctgcctctctacggggtgatcgatacaccctgttggaaactgcatacgtcccctctgtgcaccacaaataccaaggaaggaagcaacatttgtctcacacggaccgaccgcggctggtactgcgataatgccgggtctgtctccttctttccgcaagcggagacgtgtaaggtgtgcagcaacagagttttctgcgacacaatgaactctctgacccttcccagcgaagtgaatctgtgtaatgtcgatatctttaaccctaaatatgactgcaagatcatgacctccaaaacagatgtgtctagctccgtcattaccagcctcggagccatcgtgtcttgttacggcaagacaaaatgcacggcttccaataagaacaaggggattatcaaaaccttcagcaatggatgtgactatgtttctaacaagggcgtggacacagtctccgtgggcaataccctgtactatgttaacaaacaggaggggcagagcctttacgtgaagggagagcccattatcaacttttatgatcctctggtcttcccctccgacgaatttgatgcctctatcagccaagtgaatgagaaaattaaccagtccctcgctttcatccggaagtctgacgaactgctgcacaatgtgaacgccggcaagagcacaaccaatattatgatcacgaccattatcattgttatcatcgtcattctcctgtcccttatcgccgtggggctgctcctgtactgcaaagctcgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6456 - RNA, 1840 nt, synthetic construct
  misc_feature 1..1840: note = mRNA product Design a-2 comprising derived and/or modified sequence from HRSV(A2)__F-del_DSCav1_mut6 (opt6)
  source 1..1840: mol_type = other RNA
gggagagtccgctcagccaggttgcagaagcggcttagcgtgtgtcctaatcttctctctgcgtgtaggtaggcctgtgccgcaaacaagcttaccatggaactactcatattaaaagcaaacgcaataacaacgatattaacagctgtaacattctgctttgcatcaggccaaaatatcaccgaagaattttatcaaagcacatgctctgcagtatccaaaggatacttaggagcattaagaacaggctggtacacatccgtaataacaatagaactatcaaacatcaaagaaaacaaatgcaacggcacagacgccaaagtaaaactcataaaacaagaactagacaaatataaaaacgcagtaacagatctacaaatgctcatgtgctccacaccagcaaccggatctggttcagccatagcatccggcgtagccgtctgcaaagtattacacctcgaaggagaagtaaacaaaataaaatctgccctattatctacaaataaagccgtagtaagtctaagtaacggagtatcagtactaacatttaaagtcctagacctgaaaaactatatcgacaaacaactattaccaatactaaacaaacaatcctgttccatccctaacccagaaacagttatggaatttcaacaaaaaaataaccgccttttagaaataactagagaattttcagtaaacgcaggagttacaacaccagtatcaacatacatgctaacaaattcagaattattatcccttataaatgacatgcctatcacaaacgatcaaaaaaaattaatgtccaacaacgtacaaatagtaagacaacaatcatattccatcatgtgcatcataaaagaagaagtcctcgcatacgtagtgcaactaccactatacggagtcatagatacaccctgttggaaacttcacacatctccactatgcacaacaaacacgaaagaaggatccaacatatgcctaacacgaacagacagaggatggtattgcgacaacgctggaagtgtgagcttcttccctcaagcagaaacttgcaaagtatgcagcaatcgtgtattctgcgacacaatgaactcattaacactcccaagcgaagtaaacctctgcaatgtagacatctttaatccaaaatacgattgtaaaataatgacttcaaaaacagacgtctcatcatctgtaataacatctttaggagcaatagtttcttgctacggtaaaacaaaatgcaccgcatccaacaaaaacaaaggaataataaaaacattctctaacggctgcgattacgtatctaacaaaggagttgacacagtctcagtaggaaacacactatactacgtaaacaaacaagaaggacaaagcctatacgtaaaaggagaaccaataataaacttctatgacccattagtatttccaagcgatgaatttgacgcttcaatatcacaagtcaatgaaaaaataaatcagagcttagcattcataagaaaatctgatgaactactacacaatgtaaatgcaggaaaatccactaccaacataatgattaccacaattataatagttatcatagtaatactattatcactaatagccgttggattactactatactgcaaagcaagataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6457 - RNA, 1840 nt, synthetic construct
  misc_feature 1..1840: note = mRNA product Design a-2 comprising derived and/or modified sequence from HRSV(A2)__F-del_DSCav1_mut6 (opt11)
  source 1..1840: mol_type = other RNA
gggagagtccgctcagccaggttgcagaagcggcttagcgtgtgtcctaatcttctctctgcgtgtaggtaggcctgtgccgcaaacaagcttaccatggaactactcatcctaaaagcaaacgccatcaccaccatactaaccgccgtcaccttctgcttcgcctcgggacaaaacatcaccgaagagttctaccagtcaacgtgctccgccgtctcaaaaggctacctaggcgccctccgcaccgggtggtatacctccgtcataactatcgaactctctaacatcaaagaaaacaaatgtaacggcaccgacgccaaagtcaaactaatcaaacaagaactggacaaatacaaaaacgccgtcaccgacctacaaatgctcatgtgctccactccagccaccggctccggtagcgcaatcgcctcaggcgtagctgtatgcaaagtcctccacctagaaggcgaagtaaacaaaataaaatccgccctcctctcaaccaacaaggccgtcgtctcactctcaaacggcgtctccgtactcacctttaaagtcctagaccttaaaaactacatcgacaaacaactgctaccaatcctcaacaaacaatcatgcagcatcccaaacccggaaacagtcatggagttccaacagaaaaacaaccgactcctcgaaatcacccgcgagttctccgtcaacgccggagtcaccacacctgtaagcacatacatgcttactaattccgaactcctttcactaataaacgacatgccaataaccaacgaccaaaagaaactcatgtccaacaacgtacaaatcgtacgccaacaatcctactccatcatgtgcatcatcaaagaagaagtcctggcctatgtcgtacaactccccctttacggtgtcatcgacacaccctgctggaaactacacaccagccccctctgcacaacaaacaccaaagaaggctccaacatctgcctcacccgtaccgaccgaggctggtactgcgacaacgccggctccgtctccttcttcccccaagccgaaacctgcaaagtctgcagcaaccgcgtcttctgcgataccatgaactccctcacactcccatctgaagtcaacctctgcaacgtcgatattttcaatccaaaatacgactgcaaaatcatgactagcaaaaccgacgttagctcctccgtcatcacctccctcggcgccatagtttcatgctacggcaaaaccaaatgcaccgcctccaacaaaaacaaaggcatcataaaaaccttctccaacgggtgcgactacgtatctaataaaggagtcgacaccgtctcagtaggaaacaccctctactatgtcaacaaacaagaaggccaatcactatacgttaaaggcgaaccaatcatcaacttctacgacccactcgtcttccccagcgacgagtttgacgcctcaatctcgcaagtcaatgaaaagattaaccaatccctagccttcatccgaaaaagtgacgaactcctccacaacgttaacgccggcaaatctacaaccaacatcatgatcaccactataatcatcgtcatcatagtcatacttctcagcctcatcgcagtcggactcctcctttattgcaaggcacgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6458 - RNA, 1918 nt, synthetic construct
  misc_feature 1..1918: note = mRNA product Design a-3 comprising derived and/or modified sequence from HRSV(A2)__F-del_DSCav1_mut6 (opt1)
  source 1..1918: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaaccccgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6459 - RNA, 1918 nt, synthetic construct
  misc_feature 1..1918: note = mRNA product Design a-3 comprising derived and/or modified sequence from HRSV(A2)__F-del_DSCav1_mut6 (opt1)
  source 1..1918: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctcatgtgcagcacccccgccaccgggtccggcagcgccatcgcctccggcgtggcggtgtgcaaggtcctgcacctggagggggaggtgaacaagatcaagagcgccctcctgtccaccaacaaggccgtggtcagcctgtccaacggcgtgagcgtgctcacgttcaaggtcctggacctgaagaactacatcgacaagcagctcctgccgatcctgaacaagcagtcctgcagcatccccaaccccgagaccgtgatggagttccagcagaagaacaaccggctcctggagatcacccgcgagttctccgtgaacgccggggtcaccacgcccgtgagcacctacatgctgaccaactccgagctcctgagcctgatcaacgacatgccgatcaccaacgaccagaagaagctcatgagcaacaacgtgcagatcgtccggcagcagtcctacagcatcatgtgcatcatcaaggaggaggtgctggcctacgtggtccagctgcccctctacggcgtgatcgacacgccctgctggaagctgcacaccagccccctgtgcaccaccaacacgaaggaggggagcaacatctgcctcacccgcaccgaccggggctggtactgcgacaacgcgggctccgtgagcttcttcccgcaggccgagacctgcaaggtctgctccaaccgcgtgttctgcgacacgatgaacagcctgaccctgccctccgaggtcaacctctgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaacaaggggatcatcaagaccttctccaacggctgcgactacgtgagcaacaagggcgtcgacacggtgtccgtggggaacaccctgtactacgtcaacaagcaggagggccagagcctctacgtgaagggggagcccatcatcaacttctacgacccgctggtgttccccagcgacgagttcgacgcctccatcagccaggtcaacgagaagatcaaccagtccctggcgttcatccggaagtccgacgagctcctgcacaacgtgaacgccggcaagtccaccaccaacatcatgatcaccacgatcatcatcgtgatcatcgtcatcctgctcagcctgatcgccgtggggctgctcctgtactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6460 - RNA, 1918 nt, synthetic construct
  misc_feature 1..1918: note = mRNA product Design a-3 comprising derived and/or modified sequence from HRSV(A2)__F-del_DSCav1_mut6 (opt2)
  source 1..1918: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6461 - RNA, 1918 nt, synthetic construct
  misc_feature 1..1918: note = mRNA product Design a-3 comprising derived and/or modified sequence from HRSV(A2)__F-del_DSCav1_mut6 (opt3)
  source 1..1918: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagatgcttatgtgttccacacccgccaccgggtctggatcggctatagcatcaggcgtggccgtctgcaaggtgctgcacttggagggtgaggttaacaaaatcaagagcgctctcctgagtacgaataaagccgtggtctccctgtctaacggggtgagcgtactcacttttaaggttttagatctgaagaattacattgacaaacagcttttgcctatcctgaacaagcaatcctgttcaattccaaatccggaaaccgtgatggagttccagcagaaaaacaataggctactcgaaatcacacgggagtttagtgtcaacgcgggagtgactacccccgtgagcacatatatgctgaccaattctgagcttctgtccttgataaacgatatgcctattacgaacgaccagaagaaactcatgtcaaataacgtccaaatcgttcgccagcagagctacagtattatgtgcatcatcaaggaagaggtgctggcatatgtagtgcagttaccactgtacggcgtcattgatactccctgttggaaactccatacatctcctctttgcaccactaatacaaaggaaggctccaacatatgtctgacccgaacggaccgtgggtggtactgcgataatgccggaagcgtgtcgttctttccacaagctgagacctgtaaggtttgctctaacagagtgttctgcgacacaatgaactccttgactctaccctcagaagtcaatctgtgtaatgtggatatctttaaccctaaatatgactgcaagattatgaccagtaaaacagatgtaagctcctctgttatcactagcctcggtgccatagtgtcatgttacggcaagaccaaatgcacagcaagtaataagaacaaggggattatcaaaaccttctccaatggatgtgactatgtcagcaacaagggcgtggacactgtctctgtgggtaatacgctgtactatgttaacaaacaggaggggcagtcactttacgtgaagggagagccaatcattaacttttatgatccgctggtattccccagtgacgaatttgatgctagcatctcccaagtcaatgagaaaattaaccagtctttggccttcataaggaagtcggacgaactcctgcacaatgtgaacgcgggcaagagcacaaccaatatcatgattactaccatcatcattgttataatcgtgattttactgtccctaatcgccgtcggcctcctgctttactgcaaagcacggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6462 - RNA, 1918 nt, synthetic construct
  misc_feature 1..1918: note = mRNA product Design a-3 comprising derived and/or modified sequence from HRSV(A2)__F-del_DSCav1_mut6 (opt4)
  source 1..1918: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6463 - RNA, 1918 nt, synthetic construct
  misc_feature 1..1918: note = mRNA product Design a-3 comprising derived and/or modified sequence from HRSV(A2)__F-del_DSCav1_mut6 (opt5)
  source 1..1918: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagatgctgatgtgtagcacccccgccacaggatccggctctgctattgccagcggggtcgcggtgtgcaaggttctgcacctcgagggagaggtgaacaaaatcaagtccgccctgcttagcaccaataaagctgtcgtgtctctgtccaacggcgttagcgtgctcacatttaaggtcctggatcttaagaattacattgacaaacagctgctccctatcctgaacaagcaatcttgttccattccgaatcccgaaaccgtgatggagttccagcagaaaaacaatcggctgctcgaaatcacgcgcgagtttagcgtgaacgccggcgtcacaacccctgtttctacatatatgctgaccaattccgagcttctgagcctcattaacgatatgcccatcaccaacgaccagaagaaactgatgtccaataacgtgcaaatcgtgagacagcagtcttacagcattatgtgcatcattaaggaagaggtccttgcttatgtggttcagctgcctctctacggggtgatcgatacaccctgttggaaactgcatacgtcccctctgtgcaccacaaataccaaggaaggaagcaacatttgtctcacacggaccgaccgcggctggtactgcgataatgccgggtctgtctccttctttccgcaagcggagacgtgtaaggtgtgcagcaacagagttttctgcgacacaatgaactctctgacccttcccagcgaagtgaatctgtgtaatgtcgatatctttaaccctaaatatgactgcaagatcatgacctccaaaacagatgtgtctagctccgtcattaccagcctcggagccatcgtgtcttgttacggcaagacaaaatgcacggcttccaataagaacaaggggattatcaaaaccttcagcaatggatgtgactatgtttctaacaagggcgtggacacagtctccgtgggcaataccctgtactatgttaacaaacaggaggggcagagcctttacgtgaagggagagcccattatcaacttttatgatcctctggtcttcccctccgacgaatttgatgcctctatcagccaagtgaatgagaaaattaaccagtccctcgctttcatccggaagtctgacgaactgctgcacaatgtgaacgccggcaagagcacaaccaatattatgatcacgaccattatcattgttatcatcgtcattctcctgtcccttatcgccgtggggctgctcctgtactgcaaagctcgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6464 - RNA, 1918 nt, synthetic construct
  misc_feature 1..1918: note = mRNA product Design a-3 comprising derived and/or modified sequence from HRSV(A2)__F-del_DSCav1_mut6 (opt6)
  source 1..1918: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactactcatattaaaagcaaacgcaataacaacgatattaacagctgtaacattctgctttgcatcaggccaaaatatcaccgaagaattttatcaaagcacatgctctgcagtatccaaaggatacttaggagcattaagaacaggctggtacacatccgtaataacaatagaactatcaaacatcaaagaaaacaaatgcaacggcacagacgccaaagtaaaactcataaaacaagaactagacaaatataaaaacgcagtaacagatctacaaatgctcatgtgctccacaccagcaaccggatctggttcagccatagcatccggcgtagccgtctgcaaagtattacacctcgaaggagaagtaaacaaaataaaatctgccctattatctacaaataaagccgtagtaagtctaagtaacggagtatcagtactaacatttaaagtcctagacctgaaaaactatatcgacaaacaactattaccaatactaaacaaacaatcctgttccatccctaacccagaaacagttatggaatttcaacaaaaaaataaccgccttttagaaataactagagaattttcagtaaacgcaggagttacaacaccagtatcaacatacatgctaacaaattcagaattattatcccttataaatgacatgcctatcacaaacgatcaaaaaaaattaatgtccaacaacgtacaaatagtaagacaacaatcatattccatcatgtgcatcataaaagaagaagtcctcgcatacgtagtgcaactaccactatacggagtcatagatacaccctgttggaaacttcacacatctccactatgcacaacaaacacgaaagaaggatccaacatatgcctaacacgaacagacagaggatggtattgcgacaacgctggaagtgtgagcttcttccctcaagcagaaacttgcaaagtatgcagcaatcgtgtattctgcgacacaatgaactcattaacactcccaagcgaagtaaacctctgcaatgtagacatctttaatccaaaatacgattgtaaaataatgacttcaaaaacagacgtctcatcatctgtaataacatctttaggagcaatagtttcttgctacggtaaaacaaaatgcaccgcatccaacaaaaacaaaggaataataaaaacattctctaacggctgcgattacgtatctaacaaaggagttgacacagtctcagtaggaaacacactatactacgtaaacaaacaagaaggacaaagcctatacgtaaaaggagaaccaataataaacttctatgacccattagtatttccaagcgatgaatttgacgcttcaatatcacaagtcaatgaaaaaataaatcagagcttagcattcataagaaaatctgatgaactactacacaatgtaaatgcaggaaaatccactaccaacataatgattaccacaattataatagttatcatagtaatactattatcactaatagccgttggattactactatactgcaaagcaagataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6465 - RNA, 1918 nt, synthetic construct
  misc_feature 1..1918: note = mRNA product Design a-3 comprising derived and/or modified sequence from HRSV(A2)__F-del_DSCav1_mut6 (opt11)
  source 1..1918: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactactcatcctaaaagcaaacgccatcaccaccatactaaccgccgtcaccttctgcttcgcctcgggacaaaacatcaccgaagagttctaccagtcaacgtgctccgccgtctcaaaaggctacctaggcgccctccgcaccgggtggtatacctccgtcataactatcgaactctctaacatcaaagaaaacaaatgtaacggcaccgacgccaaagtcaaactaatcaaacaagaactggacaaatacaaaaacgccgtcaccgacctacaaatgctcatgtgctccactccagccaccggctccggtagcgcaatcgcctcaggcgtagctgtatgcaaagtcctccacctagaaggcgaagtaaacaaaataaaatccgccctcctctcaaccaacaaggccgtcgtctcactctcaaacggcgtctccgtactcacctttaaagtcctagaccttaaaaactacatcgacaaacaactgctaccaatcctcaacaaacaatcatgcagcatcccaaacccggaaacagtcatggagttccaacagaaaaacaaccgactcctcgaaatcacccgcgagttctccgtcaacgccggagtcaccacacctgtaagcacatacatgcttactaattccgaactcctttcactaataaacgacatgccaataaccaacgaccaaaagaaactcatgtccaacaacgtacaaatcgtacgccaacaatcctactccatcatgtgcatcatcaaagaagaagtcctggcctatgtcgtacaactccccctttacggtgtcatcgacacaccctgctggaaactacacaccagccccctctgcacaacaaacaccaaagaaggctccaacatctgcctcacccgtaccgaccgaggctggtactgcgacaacgccggctccgtctccttcttcccccaagccgaaacctgcaaagtctgcagcaaccgcgtcttctgcgataccatgaactccctcacactcccatctgaagtcaacctctgcaacgtcgatattttcaatccaaaatacgactgcaaaatcatgactagcaaaaccgacgttagctcctccgtcatcacctccctcggcgccatagtttcatgctacggcaaaaccaaatgcaccgcctccaacaaaaacaaaggcatcataaaaaccttctccaacgggtgcgactacgtatctaataaaggagtcgacaccgtctcagtaggaaacaccctctactatgtcaacaaacaagaaggccaatcactatacgttaaaggcgaaccaatcatcaacttctacgacccactcgtcttccccagcgacgagtttgacgcctcaatctcgcaagtcaatgaaaagattaaccaatccctagccttcatccgaaaaagtgacgaactcctccacaacgttaacgccggcaaatctacaaccaacatcatgatcaccactataatcatcgtcatcatagtcatacttctcagcctcatcgcagtcggactcctcctttattgcaaggcacgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6466 - RNA, 1867 nt, synthetic construct
  misc_feature 1..1867: note = mRNA product Design a-4 comprising derived and/or modified sequence from HRSV(A2)__F-del_DSCav1_mut6 (opt1)
  source 1..1867: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaaccccgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6467 - RNA, 1867 nt, synthetic construct
  misc_feature 1..1867: note = mRNA product Design a-4 comprising derived and/or modified sequence from HRSV(A2)__F-del_DSCav1_mut6 (opt1)
  source 1..1867: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctcatgtgcagcacccccgccaccgggtccggcagcgccatcgcctccggcgtggcggtgtgcaaggtcctgcacctggagggggaggtgaacaagatcaagagcgccctcctgtccaccaacaaggccgtggtcagcctgtccaacggcgtgagcgtgctcacgttcaaggtcctggacctgaagaactacatcgacaagcagctcctgccgatcctgaacaagcagtcctgcagcatccccaaccccgagaccgtgatggagttccagcagaagaacaaccggctcctggagatcacccgcgagttctccgtgaacgccggggtcaccacgcccgtgagcacctacatgctgaccaactccgagctcctgagcctgatcaacgacatgccgatcaccaacgaccagaagaagctcatgagcaacaacgtgcagatcgtccggcagcagtcctacagcatcatgtgcatcatcaaggaggaggtgctggcctacgtggtccagctgcccctctacggcgtgatcgacacgccctgctggaagctgcacaccagccccctgtgcaccaccaacacgaaggaggggagcaacatctgcctcacccgcaccgaccggggctggtactgcgacaacgcgggctccgtgagcttcttcccgcaggccgagacctgcaaggtctgctccaaccgcgtgttctgcgacacgatgaacagcctgaccctgccctccgaggtcaacctctgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaacaaggggatcatcaagaccttctccaacggctgcgactacgtgagcaacaagggcgtcgacacggtgtccgtggggaacaccctgtactacgtcaacaagcaggagggccagagcctctacgtgaagggggagcccatcatcaacttctacgacccgctggtgttccccagcgacgagttcgacgcctccatcagccaggtcaacgagaagatcaaccagtccctggcgttcatccggaagtccgacgagctcctgcacaacgtgaacgccggcaagtccaccaccaacatcatgatcaccacgatcatcatcgtgatcatcgtcatcctgctcagcctgatcgccgtggggctgctcctgtactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6468 - RNA, 1867 nt, synthetic construct
  misc_feature 1..1867: note = mRNA product Design a-4 comprising derived and/or modified sequence from HRSV(A2)__F-del_DSCav1_mut6 (opt2)
  source 1..1867: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6469 - RNA, 1867 nt, synthetic construct
  misc_feature 1..1867: note = mRNA product Design a-4 comprising derived and/or modified sequence from HRSV(A2)__F-del_DSCav1_mut6 (opt3)
  source 1..1867: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagatgcttatgtgttccacacccgccaccgggtctggatcggctatagcatcaggcgtggccgtctgcaaggtgctgcacttggagggtgaggttaacaaaatcaagagcgctctcctgagtacgaataaagccgtggtctccctgtctaacggggtgagcgtactcacttttaaggttttagatctgaagaattacattgacaaacagcttttgcctatcctgaacaagcaatcctgttcaattccaaatccggaaaccgtgatggagttccagcagaaaaacaataggctactcgaaatcacacgggagtttagtgtcaacgcgggagtgactacccccgtgagcacatatatgctgaccaattctgagcttctgtccttgataaacgatatgcctattacgaacgaccagaagaaactcatgtcaaataacgtccaaatcgttcgccagcagagctacagtattatgtgcatcatcaaggaagaggtgctggcatatgtagtgcagttaccactgtacggcgtcattgatactccctgttggaaactccatacatctcctctttgcaccactaatacaaaggaaggctccaacatatgtctgacccgaacggaccgtgggtggtactgcgataatgccggaagcgtgtcgttctttccacaagctgagacctgtaaggtttgctctaacagagtgttctgcgacacaatgaactccttgactctaccctcagaagtcaatctgtgtaatgtggatatctttaaccctaaatatgactgcaagattatgaccagtaaaacagatgtaagctcctctgttatcactagcctcggtgccatagtgtcatgttacggcaagaccaaatgcacagcaagtaataagaacaaggggattatcaaaaccttctccaatggatgtgactatgtcagcaacaagggcgtggacactgtctctgtgggtaatacgctgtactatgttaacaaacaggaggggcagtcactttacgtgaagggagagccaatcattaacttttatgatccgctggtattccccagtgacgaatttgatgctagcatctcccaagtcaatgagaaaattaaccagtctttggccttcataaggaagtcggacgaactcctgcacaatgtgaacgcgggcaagagcacaaccaatatcatgattactaccatcatcattgttataatcgtgattttactgtccctaatcgccgtcggcctcctgctttactgcaaagcacggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6470 - RNA, 1867 nt, synthetic construct
  misc_feature 1..1867: note = mRNA product Design a-4 comprising derived and/or modified sequence from HRSV(A2)__F-del_DSCav1_mut6 (opt4)
  source 1..1867: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6471 - RNA, 1867 nt, synthetic construct
  misc_feature 1..1867: note = mRNA product Design a-4 comprising derived and/or modified sequence from HRSV(A2)__F-del_DSCav1_mut6 (opt5)
  source 1..1867: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagatgctgatgtgtagcacccccgccacaggatccggctctgctattgccagcggggtcgcggtgtgcaaggttctgcacctcgagggagaggtgaacaaaatcaagtccgccctgcttagcaccaataaagctgtcgtgtctctgtccaacggcgttagcgtgctcacatttaaggtcctggatcttaagaattacattgacaaacagctgctccctatcctgaacaagcaatcttgttccattccgaatcccgaaaccgtgatggagttccagcagaaaaacaatcggctgctcgaaatcacgcgcgagtttagcgtgaacgccggcgtcacaacccctgtttctacatatatgctgaccaattccgagcttctgagcctcattaacgatatgcccatcaccaacgaccagaagaaactgatgtccaataacgtgcaaatcgtgagacagcagtcttacagcattatgtgcatcattaaggaagaggtccttgcttatgtggttcagctgcctctctacggggtgatcgatacaccctgttggaaactgcatacgtcccctctgtgcaccacaaataccaaggaaggaagcaacatttgtctcacacggaccgaccgcggctggtactgcgataatgccgggtctgtctccttctttccgcaagcggagacgtgtaaggtgtgcagcaacagagttttctgcgacacaatgaactctctgacccttcccagcgaagtgaatctgtgtaatgtcgatatctttaaccctaaatatgactgcaagatcatgacctccaaaacagatgtgtctagctccgtcattaccagcctcggagccatcgtgtcttgttacggcaagacaaaatgcacggcttccaataagaacaaggggattatcaaaaccttcagcaatggatgtgactatgtttctaacaagggcgtggacacagtctccgtgggcaataccctgtactatgttaacaaacaggaggggcagagcctttacgtgaagggagagcccattatcaacttttatgatcctctggtcttcccctccgacgaatttgatgcctctatcagccaagtgaatgagaaaattaaccagtccctcgctttcatccggaagtctgacgaactgctgcacaatgtgaacgccggcaagagcacaaccaatattatgatcacgaccattatcattgttatcatcgtcattctcctgtcccttatcgccgtggggctgctcctgtactgcaaagctcgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6472 - RNA, 1867 nt, synthetic construct
  misc_feature 1..1867: note = mRNA product Design a-4 comprising derived and/or modified sequence from HRSV(A2)__F-del_DSCav1_mut6 (opt6)
  source 1..1867: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactactcatattaaaagcaaacgcaataacaacgatattaacagctgtaacattctgctttgcatcaggccaaaatatcaccgaagaattttatcaaagcacatgctctgcagtatccaaaggatacttaggagcattaagaacaggctggtacacatccgtaataacaatagaactatcaaacatcaaagaaaacaaatgcaacggcacagacgccaaagtaaaactcataaaacaagaactagacaaatataaaaacgcagtaacagatctacaaatgctcatgtgctccacaccagcaaccggatctggttcagccatagcatccggcgtagccgtctgcaaagtattacacctcgaaggagaagtaaacaaaataaaatctgccctattatctacaaataaagccgtagtaagtctaagtaacggagtatcagtactaacatttaaagtcctagacctgaaaaactatatcgacaaacaactattaccaatactaaacaaacaatcctgttccatccctaacccagaaacagttatggaatttcaacaaaaaaataaccgccttttagaaataactagagaattttcagtaaacgcaggagttacaacaccagtatcaacatacatgctaacaaattcagaattattatcccttataaatgacatgcctatcacaaacgatcaaaaaaaattaatgtccaacaacgtacaaatagtaagacaacaatcatattccatcatgtgcatcataaaagaagaagtcctcgcatacgtagtgcaactaccactatacggagtcatagatacaccctgttggaaacttcacacatctccactatgcacaacaaacacgaaagaaggatccaacatatgcctaacacgaacagacagaggatggtattgcgacaacgctggaagtgtgagcttcttccctcaagcagaaacttgcaaagtatgcagcaatcgtgtattctgcgacacaatgaactcattaacactcccaagcgaagtaaacctctgcaatgtagacatctttaatccaaaatacgattgtaaaataatgacttcaaaaacagacgtctcatcatctgtaataacatctttaggagcaatagtttcttgctacggtaaaacaaaatgcaccgcatccaacaaaaacaaaggaataataaaaacattctctaacggctgcgattacgtatctaacaaaggagttgacacagtctcagtaggaaacacactatactacgtaaacaaacaagaaggacaaagcctatacgtaaaaggagaaccaataataaacttctatgacccattagtatttccaagcgatgaatttgacgcttcaatatcacaagtcaatgaaaaaataaatcagagcttagcattcataagaaaatctgatgaactactacacaatgtaaatgcaggaaaatccactaccaacataatgattaccacaattataatagttatcatagtaatactattatcactaatagccgttggattactactatactgcaaagcaagataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6473 - RNA, 1867 nt, synthetic construct
  misc_feature 1..1867: note = mRNA product Design a-4 comprising derived and/or modified sequence from HRSV(A2)__F-del_DSCav1_mut6 (opt11)
  source 1..1867: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactactcatcctaaaagcaaacgccatcaccaccatactaaccgccgtcaccttctgcttcgcctcgggacaaaacatcaccgaagagttctaccagtcaacgtgctccgccgtctcaaaaggctacctaggcgccctccgcaccgggtggtatacctccgtcataactatcgaactctctaacatcaaagaaaacaaatgtaacggcaccgacgccaaagtcaaactaatcaaacaagaactggacaaatacaaaaacgccgtcaccgacctacaaatgctcatgtgctccactccagccaccggctccggtagcgcaatcgcctcaggcgtagctgtatgcaaagtcctccacctagaaggcgaagtaaacaaaataaaatccgccctcctctcaaccaacaaggccgtcgtctcactctcaaacggcgtctccgtactcacctttaaagtcctagaccttaaaaactacatcgacaaacaactgctaccaatcctcaacaaacaatcatgcagcatcccaaacccggaaacagtcatggagttccaacagaaaaacaaccgactcctcgaaatcacccgcgagttctccgtcaacgccggagtcaccacacctgtaagcacatacatgcttactaattccgaactcctttcactaataaacgacatgccaataaccaacgaccaaaagaaactcatgtccaacaacgtacaaatcgtacgccaacaatcctactccatcatgtgcatcatcaaagaagaagtcctggcctatgtcgtacaactccccctttacggtgtcatcgacacaccctgctggaaactacacaccagccccctctgcacaacaaacaccaaagaaggctccaacatctgcctcacccgtaccgaccgaggctggtactgcgacaacgccggctccgtctccttcttcccccaagccgaaacctgcaaagtctgcagcaaccgcgtcttctgcgataccatgaactccctcacactcccatctgaagtcaacctctgcaacgtcgatattttcaatccaaaatacgactgcaaaatcatgactagcaaaaccgacgttagctcctccgtcatcacctccctcggcgccatagtttcatgctacggcaaaaccaaatgcaccgcctccaacaaaaacaaaggcatcataaaaaccttctccaacgggtgcgactacgtatctaataaaggagtcgacaccgtctcagtaggaaacaccctctactatgtcaacaaacaagaaggccaatcactatacgttaaaggcgaaccaatcatcaacttctacgacccactcgtcttccccagcgacgagtttgacgcctcaatctcgcaagtcaatgaaaagattaaccaatccctagccttcatccgaaaaagtgacgaactcctccacaacgttaacgccggcaaatctacaaccaacatcatgatcaccactataatcatcgtcatcatagtcatacttctcagcctcatcgcagtcggactcctcctttattgcaaggcacgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6474 - RNA, 1813 nt, synthetic construct
  misc_feature 1..1813: note = mRNA product Design a-5 comprising derived and/or modified sequence from HRSV(A2)__F-del_DSCav1_mut6 (opt1)
  source 1..1813: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaaccccgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6475 - RNA, 1813 nt, synthetic construct
  misc_feature 1..1813: note = mRNA product Design a-5 comprising derived and/or modified sequence from HRSV(A2)__F-del_DSCav1_mut6 (opt1)
  source 1..1813: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctcatgtgcagcacccccgccaccgggtccggcagcgccatcgcctccggcgtggcggtgtgcaaggtcctgcacctggagggggaggtgaacaagatcaagagcgccctcctgtccaccaacaaggccgtggtcagcctgtccaacggcgtgagcgtgctcacgttcaaggtcctggacctgaagaactacatcgacaagcagctcctgccgatcctgaacaagcagtcctgcagcatccccaaccccgagaccgtgatggagttccagcagaagaacaaccggctcctggagatcacccgcgagttctccgtgaacgccggggtcaccacgcccgtgagcacctacatgctgaccaactccgagctcctgagcctgatcaacgacatgccgatcaccaacgaccagaagaagctcatgagcaacaacgtgcagatcgtccggcagcagtcctacagcatcatgtgcatcatcaaggaggaggtgctggcctacgtggtccagctgcccctctacggcgtgatcgacacgccctgctggaagctgcacaccagccccctgtgcaccaccaacacgaaggaggggagcaacatctgcctcacccgcaccgaccggggctggtactgcgacaacgcgggctccgtgagcttcttcccgcaggccgagacctgcaaggtctgctccaaccgcgtgttctgcgacacgatgaacagcctgaccctgccctccgaggtcaacctctgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaacaaggggatcatcaagaccttctccaacggctgcgactacgtgagcaacaagggcgtcgacacggtgtccgtggggaacaccctgtactacgtcaacaagcaggagggccagagcctctacgtgaagggggagcccatcatcaacttctacgacccgctggtgttccccagcgacgagttcgacgcctccatcagccaggtcaacgagaagatcaaccagtccctggcgttcatccggaagtccgacgagctcctgcacaacgtgaacgccggcaagtccaccaccaacatcatgatcaccacgatcatcatcgtgatcatcgtcatcctgctcagcctgatcgccgtggggctgctcctgtactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6476 - RNA, 1813 nt, synthetic construct
  misc_feature 1..1813: note = mRNA product Design a-5 comprising derived and/or modified sequence from HRSV(A2)__F-del_DSCav1_mut6 (opt2)
  source 1..1813: mol_type = other RNA
gggagactttcccattctgtagcagaatttggtgttgcctgtggtcttggtcccgcggagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6477 - RNA, 1813 nt, synthetic construct
  misc_feature 1..1813: note = mRNA product Design a-5 comprising derived and/or modified sequence from HRSV(A2)__F-del_DSCav1_mut6 (opt3)
  source 1..1813: mol_type = other RNA
gggagactttcccattctgtagcagaatttggtgttgcctgtggtcttggtcccgcggagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagatgcttatgtgttccacacccgccaccgggtctggatcggctatagcatcaggcgtggccgtctgcaaggtgctgcacttggagggtgaggttaacaaaatcaagagcgctctcctgagtacgaataaagccgtggtctccctgtctaacggggtgagcgtactcacttttaaggttttagatctgaagaattacattgacaaacagcttttgcctatcctgaacaagcaatcctgttcaattccaaatccggaaaccgtgatggagttccagcagaaaaacaataggctactcgaaatcacacgggagtttagtgtcaacgcgggagtgactacccccgtgagcacatatatgctgaccaattctgagcttctgtccttgataaacgatatgcctattacgaacgaccagaagaaactcatgtcaaataacgtccaaatcgttcgccagcagagctacagtattatgtgcatcatcaaggaagaggtgctggcatatgtagtgcagttaccactgtacggcgtcattgatactccctgttggaaactccatacatctcctctttgcaccactaatacaaaggaaggctccaacatatgtctgacccgaacggaccgtgggtggtactgcgataatgccggaagcgtgtcgttctttccacaagctgagacctgtaaggtttgctctaacagagtgttctgcgacacaatgaactccttgactctaccctcagaagtcaatctgtgtaatgtggatatctttaaccctaaatatgactgcaagattatgaccagtaaaacagatgtaagctcctctgttatcactagcctcggtgccatagtgtcatgttacggcaagaccaaatgcacagcaagtaataagaacaaggggattatcaaaaccttctccaatggatgtgactatgtcagcaacaagggcgtggacactgtctctgtgggtaatacgctgtactatgttaacaaacaggaggggcagtcactttacgtgaagggagagccaatcattaacttttatgatccgctggtattccccagtgacgaatttgatgctagcatctcccaagtcaatgagaaaattaaccagtctttggccttcataaggaagtcggacgaactcctgcacaatgtgaacgcgggcaagagcacaaccaatatcatgattactaccatcatcattgttataatcgtgattttactgtccctaatcgccgtcggcctcctgctttactgcaaagcacggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6478 - RNA, 1813 nt, synthetic construct
  misc_feature 1..1813: note = mRNA product Design a-5 comprising derived and/or modified sequence from HRSV(A2)__F-del_DSCav1_mut6 (opt4)
  source 1..1813: mol_type = other RNA
gggagactttcccattctgtagcagaatttggtgttgcctgtggtcttggtcccgcggagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6479 - RNA, 1813 nt, synthetic construct
  misc_feature 1..1813: note = mRNA product Design a-5 comprising derived and/or modified sequence from HRSV(A2)__F-del_DSCav1_mut6 (opt5)
  source 1..1813: mol_type = other RNA
gggagactttcccattctgtagcagaatttggtgttgcctgtggtcttggtcccgcggagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagatgctgatgtgtagcacccccgccacaggatccggctctgctattgccagcggggtcgcggtgtgcaaggttctgcacctcgagggagaggtgaacaaaatcaagtccgccctgcttagcaccaataaagctgtcgtgtctctgtccaacggcgttagcgtgctcacatttaaggtcctggatcttaagaattacattgacaaacagctgctccctatcctgaacaagcaatcttgttccattccgaatcccgaaaccgtgatggagttccagcagaaaaacaatcggctgctcgaaatcacgcgcgagtttagcgtgaacgccggcgtcacaacccctgtttctacatatatgctgaccaattccgagcttctgagcctcattaacgatatgcccatcaccaacgaccagaagaaactgatgtccaataacgtgcaaatcgtgagacagcagtcttacagcattatgtgcatcattaaggaagaggtccttgcttatgtggttcagctgcctctctacggggtgatcgatacaccctgttggaaactgcatacgtcccctctgtgcaccacaaataccaaggaaggaagcaacatttgtctcacacggaccgaccgcggctggtactgcgataatgccgggtctgtctccttctttccgcaagcggagacgtgtaaggtgtgcagcaacagagttttctgcgacacaatgaactctctgacccttcccagcgaagtgaatctgtgtaatgtcgatatctttaaccctaaatatgactgcaagatcatgacctccaaaacagatgtgtctagctccgtcattaccagcctcggagccatcgtgtcttgttacggcaagacaaaatgcacggcttccaataagaacaaggggattatcaaaaccttcagcaatggatgtgactatgtttctaacaagggcgtggacacagtctccgtgggcaataccctgtactatgttaacaaacaggaggggcagagcctttacgtgaagggagagcccattatcaacttttatgatcctctggtcttcccctccgacgaatttgatgcctctatcagccaagtgaatgagaaaattaaccagtccctcgctttcatccggaagtctgacgaactgctgcacaatgtgaacgccggcaagagcacaaccaatattatgatcacgaccattatcattgttatcatcgtcattctcctgtcccttatcgccgtggggctgctcctgtactgcaaagctcgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6480 - RNA, 1813 nt, synthetic construct
  misc_feature 1..1813: note = mRNA product Design a-5 comprising derived and/or modified sequence from HRSV(A2)__F-del_DSCav1_mut6 (opt6)
  source 1..1813: mol_type = other RNA
gggagactttcccattctgtagcagaatttggtgttgcctgtggtcttggtcccgcggagaagcttaccatggaactactcatattaaaagcaaacgcaataacaacgatattaacagctgtaacattctgctttgcatcaggccaaaatatcaccgaagaattttatcaaagcacatgctctgcagtatccaaaggatacttaggagcattaagaacaggctggtacacatccgtaataacaatagaactatcaaacatcaaagaaaacaaatgcaacggcacagacgccaaagtaaaactcataaaacaagaactagacaaatataaaaacgcagtaacagatctacaaatgctcatgtgctccacaccagcaaccggatctggttcagccatagcatccggcgtagccgtctgcaaagtattacacctcgaaggagaagtaaacaaaataaaatctgccctattatctacaaataaagccgtagtaagtctaagtaacggagtatcagtactaacatttaaagtcctagacctgaaaaactatatcgacaaacaactattaccaatactaaacaaacaatcctgttccatccctaacccagaaacagttatggaatttcaacaaaaaaataaccgccttttagaaataactagagaattttcagtaaacgcaggagttacaacaccagtatcaacatacatgctaacaaattcagaattattatcccttataaatgacatgcctatcacaaacgatcaaaaaaaattaatgtccaacaacgtacaaatagtaagacaacaatcatattccatcatgtgcatcataaaagaagaagtcctcgcatacgtagtgcaactaccactatacggagtcatagatacaccctgttggaaacttcacacatctccactatgcacaacaaacacgaaagaaggatccaacatatgcctaacacgaacagacagaggatggtattgcgacaacgctggaagtgtgagcttcttccctcaagcagaaacttgcaaagtatgcagcaatcgtgtattctgcgacacaatgaactcattaacactcccaagcgaagtaaacctctgcaatgtagacatctttaatccaaaatacgattgtaaaataatgacttcaaaaacagacgtctcatcatctgtaataacatctttaggagcaatagtttcttgctacggtaaaacaaaatgcaccgcatccaacaaaaacaaaggaataataaaaacattctctaacggctgcgattacgtatctaacaaaggagttgacacagtctcagtaggaaacacactatactacgtaaacaaacaagaaggacaaagcctatacgtaaaaggagaaccaataataaacttctatgacccattagtatttccaagcgatgaatttgacgcttcaatatcacaagtcaatgaaaaaataaatcagagcttagcattcataagaaaatctgatgaactactacacaatgtaaatgcaggaaaatccactaccaacataatgattaccacaattataatagttatcatagtaatactattatcactaatagccgttggattactactatactgcaaagcaagataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6481 - RNA, 1813 nt, synthetic construct
  misc_feature 1..1813: note = mRNA product Design a-5 comprising derived and/or modified sequence from HRSV(A2)__F-del_DSCav1_mut6 (opt11)
  source 1..1813: mol_type = other RNA
gggagactttcccattctgtagcagaatttggtgttgcctgtggtcttggtcccgcggagaagcttaccatggaactactcatcctaaaagcaaacgccatcaccaccatactaaccgccgtcaccttctgcttcgcctcgggacaaaacatcaccgaagagttctaccagtcaacgtgctccgccgtctcaaaaggctacctaggcgccctccgcaccgggtggtatacctccgtcataactatcgaactctctaacatcaaagaaaacaaatgtaacggcaccgacgccaaagtcaaactaatcaaacaagaactggacaaatacaaaaacgccgtcaccgacctacaaatgctcatgtgctccactccagccaccggctccggtagcgcaatcgcctcaggcgtagctgtatgcaaagtcctccacctagaaggcgaagtaaacaaaataaaatccgccctcctctcaaccaacaaggccgtcgtctcactctcaaacggcgtctccgtactcacctttaaagtcctagaccttaaaaactacatcgacaaacaactgctaccaatcctcaacaaacaatcatgcagcatcccaaacccggaaacagtcatggagttccaacagaaaaacaaccgactcctcgaaatcacccgcgagttctccgtcaacgccggagtcaccacacctgtaagcacatacatgcttactaattccgaactcctttcactaataaacgacatgccaataaccaacgaccaaaagaaactcatgtccaacaacgtacaaatcgtacgccaacaatcctactccatcatgtgcatcatcaaagaagaagtcctggcctatgtcgtacaactccccctttacggtgtcatcgacacaccctgctggaaactacacaccagccccctctgcacaacaaacaccaaagaaggctccaacatctgcctcacccgtaccgaccgaggctggtactgcgacaacgccggctccgtctccttcttcccccaagccgaaacctgcaaagtctgcagcaaccgcgtcttctgcgataccatgaactccctcacactcccatctgaagtcaacctctgcaacgtcgatattttcaatccaaaatacgactgcaaaatcatgactagcaaaaccgacgttagctcctccgtcatcacctccctcggcgccatagtttcatgctacggcaaaaccaaatgcaccgcctccaacaaaaacaaaggcatcataaaaaccttctccaacgggtgcgactacgtatctaataaaggagtcgacaccgtctcagtaggaaacaccctctactatgtcaacaaacaagaaggccaatcactatacgttaaaggcgaaccaatcatcaacttctacgacccactcgtcttccccagcgacgagtttgacgcctcaatctcgcaagtcaatgaaaagattaaccaatccctagccttcatccgaaaaagtgacgaactcctccacaacgttaacgccggcaaatctacaaccaacatcatgatcaccactataatcatcgtcatcatagtcatacttctcagcctcatcgcagtcggactcctcctttattgcaaggcacgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6482 - RNA, 1994 nt, synthetic construct
  misc_feature 1..1994: note = mRNA product Design b-1 comprising derived and/or modified sequence from HRSV(A2)__F-del_DSCav1_mut6 (opt1)
  source 1..1994: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaaccccgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6483 - RNA, 1994 nt, synthetic construct
  misc_feature 1..1994: note = mRNA product Design b-1 comprising derived and/or modified sequence from HRSV(A2)__F-del_DSCav1_mut6 (opt1)
  source 1..1994: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctcatgtgcagcacccccgccaccgggtccggcagcgccatcgcctccggcgtggcggtgtgcaaggtcctgcacctggagggggaggtgaacaagatcaagagcgccctcctgtccaccaacaaggccgtggtcagcctgtccaacggcgtgagcgtgctcacgttcaaggtcctggacctgaagaactacatcgacaagcagctcctgccgatcctgaacaagcagtcctgcagcatccccaaccccgagaccgtgatggagttccagcagaagaacaaccggctcctggagatcacccgcgagttctccgtgaacgccggggtcaccacgcccgtgagcacctacatgctgaccaactccgagctcctgagcctgatcaacgacatgccgatcaccaacgaccagaagaagctcatgagcaacaacgtgcagatcgtccggcagcagtcctacagcatcatgtgcatcatcaaggaggaggtgctggcctacgtggtccagctgcccctctacggcgtgatcgacacgccctgctggaagctgcacaccagccccctgtgcaccaccaacacgaaggaggggagcaacatctgcctcacccgcaccgaccggggctggtactgcgacaacgcgggctccgtgagcttcttcccgcaggccgagacctgcaaggtctgctccaaccgcgtgttctgcgacacgatgaacagcctgaccctgccctccgaggtcaacctctgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaacaaggggatcatcaagaccttctccaacggctgcgactacgtgagcaacaagggcgtcgacacggtgtccgtggggaacaccctgtactacgtcaacaagcaggagggccagagcctctacgtgaagggggagcccatcatcaacttctacgacccgctggtgttccccagcgacgagttcgacgcctccatcagccaggtcaacgagaagatcaaccagtccctggcgttcatccggaagtccgacgagctcctgcacaacgtgaacgccggcaagtccaccaccaacatcatgatcaccacgatcatcatcgtgatcatcgtcatcctgctcagcctgatcgccgtggggctgctcctgtactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6484 - RNA, 1994 nt, synthetic construct
  misc_feature 1..1994: note = mRNA product Design b-1 comprising derived and/or modified sequence from HRSV(A2)__F-del_DSCav1_mut6 (opt2)
  source 1..1994: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6485 - RNA, 1994 nt, synthetic construct
  misc_feature 1..1994: note = mRNA product Design b-1 comprising derived and/or modified sequence from HRSV(A2)__F-del_DSCav1_mut6 (opt3)
  source 1..1994: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagatgcttatgtgttccacacccgccaccgggtctggatcggctatagcatcaggcgtggccgtctgcaaggtgctgcacttggagggtgaggttaacaaaatcaagagcgctctcctgagtacgaataaagccgtggtctccctgtctaacggggtgagcgtactcacttttaaggttttagatctgaagaattacattgacaaacagcttttgcctatcctgaacaagcaatcctgttcaattccaaatccggaaaccgtgatggagttccagcagaaaaacaataggctactcgaaatcacacgggagtttagtgtcaacgcgggagtgactacccccgtgagcacatatatgctgaccaattctgagcttctgtccttgataaacgatatgcctattacgaacgaccagaagaaactcatgtcaaataacgtccaaatcgttcgccagcagagctacagtattatgtgcatcatcaaggaagaggtgctggcatatgtagtgcagttaccactgtacggcgtcattgatactccctgttggaaactccatacatctcctctttgcaccactaatacaaaggaaggctccaacatatgtctgacccgaacggaccgtgggtggtactgcgataatgccggaagcgtgtcgttctttccacaagctgagacctgtaaggtttgctctaacagagtgttctgcgacacaatgaactccttgactctaccctcagaagtcaatctgtgtaatgtggatatctttaaccctaaatatgactgcaagattatgaccagtaaaacagatgtaagctcctctgttatcactagcctcggtgccatagtgtcatgttacggcaagaccaaatgcacagcaagtaataagaacaaggggattatcaaaaccttctccaatggatgtgactatgtcagcaacaagggcgtggacactgtctctgtgggtaatacgctgtactatgttaacaaacaggaggggcagtcactttacgtgaagggagagccaatcattaacttttatgatccgctggtattccccagtgacgaatttgatgctagcatctcccaagtcaatgagaaaattaaccagtctttggccttcataaggaagtcggacgaactcctgcacaatgtgaacgcgggcaagagcacaaccaatatcatgattactaccatcatcattgttataatcgtgattttactgtccctaatcgccgtcggcctcctgctttactgcaaagcacggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6486 - RNA, 1994 nt, synthetic construct
  misc_feature 1..1994: note = mRNA product Design b-1 comprising derived and/or modified sequence from HRSV(A2)__F-del_DSCav1_mut6 (opt4)
  source 1..1994: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6487 - RNA, 1994 nt, synthetic construct
  misc_feature 1..1994: note = mRNA product Design b-1 comprising derived and/or modified sequence from HRSV(A2)__F-del_DSCav1_mut6 (opt5)
  source 1..1994: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagatgctgatgtgtagcacccccgccacaggatccggctctgctattgccagcggggtcgcggtgtgcaaggttctgcacctcgagggagaggtgaacaaaatcaagtccgccctgcttagcaccaataaagctgtcgtgtctctgtccaacggcgttagcgtgctcacatttaaggtcctggatcttaagaattacattgacaaacagctgctccctatcctgaacaagcaatcttgttccattccgaatcccgaaaccgtgatggagttccagcagaaaaacaatcggctgctcgaaatcacgcgcgagtttagcgtgaacgccggcgtcacaacccctgtttctacatatatgctgaccaattccgagcttctgagcctcattaacgatatgcccatcaccaacgaccagaagaaactgatgtccaataacgtgcaaatcgtgagacagcagtcttacagcattatgtgcatcattaaggaagaggtccttgcttatgtggttcagctgcctctctacggggtgatcgatacaccctgttggaaactgcatacgtcccctctgtgcaccacaaataccaaggaaggaagcaacatttgtctcacacggaccgaccgcggctggtactgcgataatgccgggtctgtctccttctttccgcaagcggagacgtgtaaggtgtgcagcaacagagttttctgcgacacaatgaactctctgacccttcccagcgaagtgaatctgtgtaatgtcgatatctttaaccctaaatatgactgcaagatcatgacctccaaaacagatgtgtctagctccgtcattaccagcctcggagccatcgtgtcttgttacggcaagacaaaatgcacggcttccaataagaacaaggggattatcaaaaccttcagcaatggatgtgactatgtttctaacaagggcgtggacacagtctccgtgggcaataccctgtactatgttaacaaacaggaggggcagagcctttacgtgaagggagagcccattatcaacttttatgatcctctggtcttcccctccgacgaatttgatgcctctatcagccaagtgaatgagaaaattaaccagtccctcgctttcatccggaagtctgacgaactgctgcacaatgtgaacgccggcaagagcacaaccaatattatgatcacgaccattatcattgttatcatcgtcattctcctgtcccttatcgccgtggggctgctcctgtactgcaaagctcgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6488 - RNA, 1994 nt, synthetic construct
  misc_feature 1..1994: note = mRNA product Design b-1 comprising derived and/or modified sequence from HRSV(A2)__F-del_DSCav1_mut6 (opt6)
  source 1..1994: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggaactactcatattaaaagcaaacgcaataacaacgatattaacagctgtaacattctgctttgcatcaggccaaaatatcaccgaagaattttatcaaagcacatgctctgcagtatccaaaggatacttaggagcattaagaacaggctggtacacatccgtaataacaatagaactatcaaacatcaaagaaaacaaatgcaacggcacagacgccaaagtaaaactcataaaacaagaactagacaaatataaaaacgcagtaacagatctacaaatgctcatgtgctccacaccagcaaccggatctggttcagccatagcatccggcgtagccgtctgcaaagtattacacctcgaaggagaagtaaacaaaataaaatctgccctattatctacaaataaagccgtagtaagtctaagtaacggagtatcagtactaacatttaaagtcctagacctgaaaaactatatcgacaaacaactattaccaatactaaacaaacaatcctgttccatccctaacccagaaacagttatggaatttcaacaaaaaaataaccgccttttagaaataactagagaattttcagtaaacgcaggagttacaacaccagtatcaacatacatgctaacaaattcagaattattatcccttataaatgacatgcctatcacaaacgatcaaaaaaaattaatgtccaacaacgtacaaatagtaagacaacaatcatattccatcatgtgcatcataaaagaagaagtcctcgcatacgtagtgcaactaccactatacggagtcatagatacaccctgttggaaacttcacacatctccactatgcacaacaaacacgaaagaaggatccaacatatgcctaacacgaacagacagaggatggtattgcgacaacgctggaagtgtgagcttcttccctcaagcagaaacttgcaaagtatgcagcaatcgtgtattctgcgacacaatgaactcattaacactcccaagcgaagtaaacctctgcaatgtagacatctttaatccaaaatacgattgtaaaataatgacttcaaaaacagacgtctcatcatctgtaataacatctttaggagcaatagtttcttgctacggtaaaacaaaatgcaccgcatccaacaaaaacaaaggaataataaaaacattctctaacggctgcgattacgtatctaacaaaggagttgacacagtctcagtaggaaacacactatactacgtaaacaaacaagaaggacaaagcctatacgtaaaaggagaaccaataataaacttctatgacccattagtatttccaagcgatgaatttgacgcttcaatatcacaagtcaatgaaaaaataaatcagagcttagcattcataagaaaatctgatgaactactacacaatgtaaatgcaggaaaatccactaccaacataatgattaccacaattataatagttatcatagtaatactattatcactaatagccgttggattactactatactgcaaagcaagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6489 - RNA, 1994 nt, synthetic construct
  misc_feature 1..1994: note = mRNA product Design b-1 comprising derived and/or modified sequence from HRSV(A2)__F-del_DSCav1_mut6 (opt11)
  source 1..1994: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggaactactcatcctaaaagcaaacgccatcaccaccatactaaccgccgtcaccttctgcttcgcctcgggacaaaacatcaccgaagagttctaccagtcaacgtgctccgccgtctcaaaaggctacctaggcgccctccgcaccgggtggtatacctccgtcataactatcgaactctctaacatcaaagaaaacaaatgtaacggcaccgacgccaaagtcaaactaatcaaacaagaactggacaaatacaaaaacgccgtcaccgacctacaaatgctcatgtgctccactccagccaccggctccggtagcgcaatcgcctcaggcgtagctgtatgcaaagtcctccacctagaaggcgaagtaaacaaaataaaatccgccctcctctcaaccaacaaggccgtcgtctcactctcaaacggcgtctccgtactcacctttaaagtcctagaccttaaaaactacatcgacaaacaactgctaccaatcctcaacaaacaatcatgcagcatcccaaacccggaaacagtcatggagttccaacagaaaaacaaccgactcctcgaaatcacccgcgagttctccgtcaacgccggagtcaccacacctgtaagcacatacatgcttactaattccgaactcctttcactaataaacgacatgccaataaccaacgaccaaaagaaactcatgtccaacaacgtacaaatcgtacgccaacaatcctactccatcatgtgcatcatcaaagaagaagtcctggcctatgtcgtacaactccccctttacggtgtcatcgacacaccctgctggaaactacacaccagccccctctgcacaacaaacaccaaagaaggctccaacatctgcctcacccgtaccgaccgaggctggtactgcgacaacgccggctccgtctccttcttcccccaagccgaaacctgcaaagtctgcagcaaccgcgtcttctgcgataccatgaactccctcacactcccatctgaagtcaacctctgcaacgtcgatattttcaatccaaaatacgactgcaaaatcatgactagcaaaaccgacgttagctcctccgtcatcacctccctcggcgccatagtttcatgctacggcaaaaccaaatgcaccgcctccaacaaaaacaaaggcatcataaaaaccttctccaacgggtgcgactacgtatctaataaaggagtcgacaccgtctcagtaggaaacaccctctactatgtcaacaaacaagaaggccaatcactatacgttaaaggcgaaccaatcatcaacttctacgacccactcgtcttccccagcgacgagtttgacgcctcaatctcgcaagtcaatgaaaagattaaccaatccctagccttcatccgaaaaagtgacgaactcctccacaacgttaacgccggcaaatctacaaccaacatcatgatcaccactataatcatcgtcatcatagtcatacttctcagcctcatcgcagtcggactcctcctttattgcaaggcacgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6490 - RNA, 1814 nt, synthetic construct
  misc_feature 1..1814: note = mRNA product Design b-2 comprising derived and/or modified sequence from HRSV(A2)__F-del_DSCav1_mut6 (opt1)
  source 1..1814: mol_type = other RNA
gggagagcctctgctggagtccggggagtggcgttggctgctagagcgaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaaccccgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6491 - RNA, 1814 nt, synthetic construct
  misc_feature 1..1814: note = mRNA product Design b-2 comprising derived and/or modified sequence from HRSV(A2)__F-del_DSCav1_mut6 (opt1)
  source 1..1814: mol_type = other RNA
gggagagcctctgctggagtccggggagtggcgttggctgctagagcgaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctcatgtgcagcacccccgccaccgggtccggcagcgccatcgcctccggcgtggcggtgtgcaaggtcctgcacctggagggggaggtgaacaagatcaagagcgccctcctgtccaccaacaaggccgtggtcagcctgtccaacggcgtgagcgtgctcacgttcaaggtcctggacctgaagaactacatcgacaagcagctcctgccgatcctgaacaagcagtcctgcagcatccccaaccccgagaccgtgatggagttccagcagaagaacaaccggctcctggagatcacccgcgagttctccgtgaacgccggggtcaccacgcccgtgagcacctacatgctgaccaactccgagctcctgagcctgatcaacgacatgccgatcaccaacgaccagaagaagctcatgagcaacaacgtgcagatcgtccggcagcagtcctacagcatcatgtgcatcatcaaggaggaggtgctggcctacgtggtccagctgcccctctacggcgtgatcgacacgccctgctggaagctgcacaccagccccctgtgcaccaccaacacgaaggaggggagcaacatctgcctcacccgcaccgaccggggctggtactgcgacaacgcgggctccgtgagcttcttcccgcaggccgagacctgcaaggtctgctccaaccgcgtgttctgcgacacgatgaacagcctgaccctgccctccgaggtcaacctctgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaacaaggggatcatcaagaccttctccaacggctgcgactacgtgagcaacaagggcgtcgacacggtgtccgtggggaacaccctgtactacgtcaacaagcaggagggccagagcctctacgtgaagggggagcccatcatcaacttctacgacccgctggtgttccccagcgacgagttcgacgcctccatcagccaggtcaacgagaagatcaaccagtccctggcgttcatccggaagtccgacgagctcctgcacaacgtgaacgccggcaagtccaccaccaacatcatgatcaccacgatcatcatcgtgatcatcgtcatcctgctcagcctgatcgccgtggggctgctcctgtactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6492 - RNA, 1814 nt, synthetic construct
  misc_feature 1..1814: note = mRNA product Design b-2 comprising derived and/or modified sequence from HRSV(A2)__F-del_DSCav1_mut6 (opt2)
  source 1..1814: mol_type = other RNA
gggagagcctctgctggagtccggggagtggcgttggctgctagagcgaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6493 - RNA, 1814 nt, synthetic construct
  misc_feature 1..1814: note = mRNA product Design b-2 comprising derived and/or modified sequence from HRSV(A2)__F-del_DSCav1_mut6 (opt3)
  source 1..1814: mol_type = other RNA
gggagagcctctgctggagtccggggagtggcgttggctgctagagcgaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagatgcttatgtgttccacacccgccaccgggtctggatcggctatagcatcaggcgtggccgtctgcaaggtgctgcacttggagggtgaggttaacaaaatcaagagcgctctcctgagtacgaataaagccgtggtctccctgtctaacggggtgagcgtactcacttttaaggttttagatctgaagaattacattgacaaacagcttttgcctatcctgaacaagcaatcctgttcaattccaaatccggaaaccgtgatggagttccagcagaaaaacaataggctactcgaaatcacacgggagtttagtgtcaacgcgggagtgactacccccgtgagcacatatatgctgaccaattctgagcttctgtccttgataaacgatatgcctattacgaacgaccagaagaaactcatgtcaaataacgtccaaatcgttcgccagcagagctacagtattatgtgcatcatcaaggaagaggtgctggcatatgtagtgcagttaccactgtacggcgtcattgatactccctgttggaaactccatacatctcctctttgcaccactaatacaaaggaaggctccaacatatgtctgacccgaacggaccgtgggtggtactgcgataatgccggaagcgtgtcgttctttccacaagctgagacctgtaaggtttgctctaacagagtgttctgcgacacaatgaactccttgactctaccctcagaagtcaatctgtgtaatgtggatatctttaaccctaaatatgactgcaagattatgaccagtaaaacagatgtaagctcctctgttatcactagcctcggtgccatagtgtcatgttacggcaagaccaaatgcacagcaagtaataagaacaaggggattatcaaaaccttctccaatggatgtgactatgtcagcaacaagggcgtggacactgtctctgtgggtaatacgctgtactatgttaacaaacaggaggggcagtcactttacgtgaagggagagccaatcattaacttttatgatccgctggtattccccagtgacgaatttgatgctagcatctcccaagtcaatgagaaaattaaccagtctttggccttcataaggaagtcggacgaactcctgcacaatgtgaacgcgggcaagagcacaaccaatatcatgattactaccatcatcattgttataatcgtgattttactgtccctaatcgccgtcggcctcctgctttactgcaaagcacggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6494 - RNA, 1814 nt, synthetic construct
  misc_feature 1..1814: note = mRNA product Design b-2 comprising derived and/or modified sequence from HRSV(A2)__F-del_DSCav1_mut6 (opt4)
  source 1..1814: mol_type = other RNA
gggagagcctctgctggagtccggggagtggcgttggctgctagagcgaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6495 - RNA, 1814 nt, synthetic construct
  misc_feature 1..1814: note = mRNA product Design b-2 comprising derived and/or modified sequence from HRSV(A2)__F-del_DSCav1_mut6 (opt5)
  source 1..1814: mol_type = other RNA
gggagagcctctgctggagtccggggagtggcgttggctgctagagcgaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagatgctgatgtgtagcacccccgccacaggatccggctctgctattgccagcggggtcgcggtgtgcaaggttctgcacctcgagggagaggtgaacaaaatcaagtccgccctgcttagcaccaataaagctgtcgtgtctctgtccaacggcgttagcgtgctcacatttaaggtcctggatcttaagaattacattgacaaacagctgctccctatcctgaacaagcaatcttgttccattccgaatcccgaaaccgtgatggagttccagcagaaaaacaatcggctgctcgaaatcacgcgcgagtttagcgtgaacgccggcgtcacaacccctgtttctacatatatgctgaccaattccgagcttctgagcctcattaacgatatgcccatcaccaacgaccagaagaaactgatgtccaataacgtgcaaatcgtgagacagcagtcttacagcattatgtgcatcattaaggaagaggtccttgcttatgtggttcagctgcctctctacggggtgatcgatacaccctgttggaaactgcatacgtcccctctgtgcaccacaaataccaaggaaggaagcaacatttgtctcacacggaccgaccgcggctggtactgcgataatgccgggtctgtctccttctttccgcaagcggagacgtgtaaggtgtgcagcaacagagttttctgcgacacaatgaactctctgacccttcccagcgaagtgaatctgtgtaatgtcgatatctttaaccctaaatatgactgcaagatcatgacctccaaaacagatgtgtctagctccgtcattaccagcctcggagccatcgtgtcttgttacggcaagacaaaatgcacggcttccaataagaacaaggggattatcaaaaccttcagcaatggatgtgactatgtttctaacaagggcgtggacacagtctccgtgggcaataccctgtactatgttaacaaacaggaggggcagagcctttacgtgaagggagagcccattatcaacttttatgatcctctggtcttcccctccgacgaatttgatgcctctatcagccaagtgaatgagaaaattaaccagtccctcgctttcatccggaagtctgacgaactgctgcacaatgtgaacgccggcaagagcacaaccaatattatgatcacgaccattatcattgttatcatcgtcattctcctgtcccttatcgccgtggggctgctcctgtactgcaaagctcgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6496 - RNA, 1814 nt, synthetic construct
  misc_feature 1..1814: note = mRNA product Design b-2 comprising derived and/or modified sequence from HRSV(A2)__F-del_DSCav1_mut6 (opt6)
  source 1..1814: mol_type = other RNA
gggagagcctctgctggagtccggggagtggcgttggctgctagagcgaagcttaccatggaactactcatattaaaagcaaacgcaataacaacgatattaacagctgtaacattctgctttgcatcaggccaaaatatcaccgaagaattttatcaaagcacatgctctgcagtatccaaaggatacttaggagcattaagaacaggctggtacacatccgtaataacaatagaactatcaaacatcaaagaaaacaaatgcaacggcacagacgccaaagtaaaactcataaaacaagaactagacaaatataaaaacgcagtaacagatctacaaatgctcatgtgctccacaccagcaaccggatctggttcagccatagcatccggcgtagccgtctgcaaagtattacacctcgaaggagaagtaaacaaaataaaatctgccctattatctacaaataaagccgtagtaagtctaagtaacggagtatcagtactaacatttaaagtcctagacctgaaaaactatatcgacaaacaactattaccaatactaaacaaacaatcctgttccatccctaacccagaaacagttatggaatttcaacaaaaaaataaccgccttttagaaataactagagaattttcagtaaacgcaggagttacaacaccagtatcaacatacatgctaacaaattcagaattattatcccttataaatgacatgcctatcacaaacgatcaaaaaaaattaatgtccaacaacgtacaaatagtaagacaacaatcatattccatcatgtgcatcataaaagaagaagtcctcgcatacgtagtgcaactaccactatacggagtcatagatacaccctgttggaaacttcacacatctccactatgcacaacaaacacgaaagaaggatccaacatatgcctaacacgaacagacagaggatggtattgcgacaacgctggaagtgtgagcttcttccctcaagcagaaacttgcaaagtatgcagcaatcgtgtattctgcgacacaatgaactcattaacactcccaagcgaagtaaacctctgcaatgtagacatctttaatccaaaatacgattgtaaaataatgacttcaaaaacagacgtctcatcatctgtaataacatctttaggagcaatagtttcttgctacggtaaaacaaaatgcaccgcatccaacaaaaacaaaggaataataaaaacattctctaacggctgcgattacgtatctaacaaaggagttgacacagtctcagtaggaaacacactatactacgtaaacaaacaagaaggacaaagcctatacgtaaaaggagaaccaataataaacttctatgacccattagtatttccaagcgatgaatttgacgcttcaatatcacaagtcaatgaaaaaataaatcagagcttagcattcataagaaaatctgatgaactactacacaatgtaaatgcaggaaaatccactaccaacataatgattaccacaattataatagttatcatagtaatactattatcactaatagccgttggattactactatactgcaaagcaagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6497 - RNA, 1814 nt, synthetic construct
  misc_feature 1..1814: note = mRNA product Design b-2 comprising derived and/or modified sequence from HRSV(A2)__F-del_DSCav1_mut6 (opt11)
  source 1..1814: mol_type = other RNA
gggagagcctctgctggagtccggggagtggcgttggctgctagagcgaagcttaccatggaactactcatcctaaaagcaaacgccatcaccaccatactaaccgccgtcaccttctgcttcgcctcgggacaaaacatcaccgaagagttctaccagtcaacgtgctccgccgtctcaaaaggctacctaggcgccctccgcaccgggtggtatacctccgtcataactatcgaactctctaacatcaaagaaaacaaatgtaacggcaccgacgccaaagtcaaactaatcaaacaagaactggacaaatacaaaaacgccgtcaccgacctacaaatgctcatgtgctccactccagccaccggctccggtagcgcaatcgcctcaggcgtagctgtatgcaaagtcctccacctagaaggcgaagtaaacaaaataaaatccgccctcctctcaaccaacaaggccgtcgtctcactctcaaacggcgtctccgtactcacctttaaagtcctagaccttaaaaactacatcgacaaacaactgctaccaatcctcaacaaacaatcatgcagcatcccaaacccggaaacagtcatggagttccaacagaaaaacaaccgactcctcgaaatcacccgcgagttctccgtcaacgccggagtcaccacacctgtaagcacatacatgcttactaattccgaactcctttcactaataaacgacatgccaataaccaacgaccaaaagaaactcatgtccaacaacgtacaaatcgtacgccaacaatcctactccatcatgtgcatcatcaaagaagaagtcctggcctatgtcgtacaactccccctttacggtgtcatcgacacaccctgctggaaactacacaccagccccctctgcacaacaaacaccaaagaaggctccaacatctgcctcacccgtaccgaccgaggctggtactgcgacaacgccggctccgtctccttcttcccccaagccgaaacctgcaaagtctgcagcaaccgcgtcttctgcgataccatgaactccctcacactcccatctgaagtcaacctctgcaacgtcgatattttcaatccaaaatacgactgcaaaatcatgactagcaaaaccgacgttagctcctccgtcatcacctccctcggcgccatagtttcatgctacggcaaaaccaaatgcaccgcctccaacaaaaacaaaggcatcataaaaaccttctccaacgggtgcgactacgtatctaataaaggagtcgacaccgtctcagtaggaaacaccctctactatgtcaacaaacaagaaggccaatcactatacgttaaaggcgaaccaatcatcaacttctacgacccactcgtcttccccagcgacgagtttgacgcctcaatctcgcaagtcaatgaaaagattaaccaatccctagccttcatccgaaaaagtgacgaactcctccacaacgttaacgccggcaaatctacaaccaacatcatgatcaccactataatcatcgtcatcatagtcatacttctcagcctcatcgcagtcggactcctcctttattgcaaggcacgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6498 - RNA, 1834 nt, synthetic construct
  misc_feature 1..1834: note = mRNA product Design b-3 comprising derived and/or modified sequence from HRSV(A2)__F-del_DSCav1_mut6 (opt1)
  source 1..1834: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaaccccgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6499 - RNA, 1834 nt, synthetic construct
  misc_feature 1..1834: note = mRNA product Design b-3 comprising derived and/or modified sequence from HRSV(A2)__F-del_DSCav1_mut6 (opt1)
  source 1..1834: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctcatgtgcagcacccccgccaccgggtccggcagcgccatcgcctccggcgtggcggtgtgcaaggtcctgcacctggagggggaggtgaacaagatcaagagcgccctcctgtccaccaacaaggccgtggtcagcctgtccaacggcgtgagcgtgctcacgttcaaggtcctggacctgaagaactacatcgacaagcagctcctgccgatcctgaacaagcagtcctgcagcatccccaaccccgagaccgtgatggagttccagcagaagaacaaccggctcctggagatcacccgcgagttctccgtgaacgccggggtcaccacgcccgtgagcacctacatgctgaccaactccgagctcctgagcctgatcaacgacatgccgatcaccaacgaccagaagaagctcatgagcaacaacgtgcagatcgtccggcagcagtcctacagcatcatgtgcatcatcaaggaggaggtgctggcctacgtggtccagctgcccctctacggcgtgatcgacacgccctgctggaagctgcacaccagccccctgtgcaccaccaacacgaaggaggggagcaacatctgcctcacccgcaccgaccggggctggtactgcgacaacgcgggctccgtgagcttcttcccgcaggccgagacctgcaaggtctgctccaaccgcgtgttctgcgacacgatgaacagcctgaccctgccctccgaggtcaacctctgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaacaaggggatcatcaagaccttctccaacggctgcgactacgtgagcaacaagggcgtcgacacggtgtccgtggggaacaccctgtactacgtcaacaagcaggagggccagagcctctacgtgaagggggagcccatcatcaacttctacgacccgctggtgttccccagcgacgagttcgacgcctccatcagccaggtcaacgagaagatcaaccagtccctggcgttcatccggaagtccgacgagctcctgcacaacgtgaacgccggcaagtccaccaccaacatcatgatcaccacgatcatcatcgtgatcatcgtcatcctgctcagcctgatcgccgtggggctgctcctgtactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6500 - RNA, 1834 nt, synthetic construct
  misc_feature 1..1834: note = mRNA product Design b-3 comprising derived and/or modified sequence from HRSV(A2)__F-del_DSCav1_mut6 (opt2)
  source 1..1834: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6501 - RNA, 1834 nt, synthetic construct
  misc_feature 1..1834: note = mRNA product Design b-3 comprising derived and/or modified sequence from HRSV(A2)__F-del_DSCav1_mut6 (opt3)
  source 1..1834: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagatgcttatgtgttccacacccgccaccgggtctggatcggctatagcatcaggcgtggccgtctgcaaggtgctgcacttggagggtgaggttaacaaaatcaagagcgctctcctgagtacgaataaagccgtggtctccctgtctaacggggtgagcgtactcacttttaaggttttagatctgaagaattacattgacaaacagcttttgcctatcctgaacaagcaatcctgttcaattccaaatccggaaaccgtgatggagttccagcagaaaaacaataggctactcgaaatcacacgggagtttagtgtcaacgcgggagtgactacccccgtgagcacatatatgctgaccaattctgagcttctgtccttgataaacgatatgcctattacgaacgaccagaagaaactcatgtcaaataacgtccaaatcgttcgccagcagagctacagtattatgtgcatcatcaaggaagaggtgctggcatatgtagtgcagttaccactgtacggcgtcattgatactccctgttggaaactccatacatctcctctttgcaccactaatacaaaggaaggctccaacatatgtctgacccgaacggaccgtgggtggtactgcgataatgccggaagcgtgtcgttctttccacaagctgagacctgtaaggtttgctctaacagagtgttctgcgacacaatgaactccttgactctaccctcagaagtcaatctgtgtaatgtggatatctttaaccctaaatatgactgcaagattatgaccagtaaaacagatgtaagctcctctgttatcactagcctcggtgccatagtgtcatgttacggcaagaccaaatgcacagcaagtaataagaacaaggggattatcaaaaccttctccaatggatgtgactatgtcagcaacaagggcgtggacactgtctctgtgggtaatacgctgtactatgttaacaaacaggaggggcagtcactttacgtgaagggagagccaatcattaacttttatgatccgctggtattccccagtgacgaatttgatgctagcatctcccaagtcaatgagaaaattaaccagtctttggccttcataaggaagtcggacgaactcctgcacaatgtgaacgcgggcaagagcacaaccaatatcatgattactaccatcatcattgttataatcgtgattttactgtccctaatcgccgtcggcctcctgctttactgcaaagcacggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6502 - RNA, 1834 nt, synthetic construct
  misc_feature 1..1834: note = mRNA product Design b-3 comprising derived and/or modified sequence from HRSV(A2)__F-del_DSCav1_mut6 (opt4)
  source 1..1834: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6503 - RNA, 1834 nt, synthetic construct
  misc_feature 1..1834: note = mRNA product Design b-3 comprising derived and/or modified sequence from HRSV(A2)__F-del_DSCav1_mut6 (opt5)
  source 1..1834: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagatgctgatgtgtagcacccccgccacaggatccggctctgctattgccagcggggtcgcggtgtgcaaggttctgcacctcgagggagaggtgaacaaaatcaagtccgccctgcttagcaccaataaagctgtcgtgtctctgtccaacggcgttagcgtgctcacatttaaggtcctggatcttaagaattacattgacaaacagctgctccctatcctgaacaagcaatcttgttccattccgaatcccgaaaccgtgatggagttccagcagaaaaacaatcggctgctcgaaatcacgcgcgagtttagcgtgaacgccggcgtcacaacccctgtttctacatatatgctgaccaattccgagcttctgagcctcattaacgatatgcccatcaccaacgaccagaagaaactgatgtccaataacgtgcaaatcgtgagacagcagtcttacagcattatgtgcatcattaaggaagaggtccttgcttatgtggttcagctgcctctctacggggtgatcgatacaccctgttggaaactgcatacgtcccctctgtgcaccacaaataccaaggaaggaagcaacatttgtctcacacggaccgaccgcggctggtactgcgataatgccgggtctgtctccttctttccgcaagcggagacgtgtaaggtgtgcagcaacagagttttctgcgacacaatgaactctctgacccttcccagcgaagtgaatctgtgtaatgtcgatatctttaaccctaaatatgactgcaagatcatgacctccaaaacagatgtgtctagctccgtcattaccagcctcggagccatcgtgtcttgttacggcaagacaaaatgcacggcttccaataagaacaaggggattatcaaaaccttcagcaatggatgtgactatgtttctaacaagggcgtggacacagtctccgtgggcaataccctgtactatgttaacaaacaggaggggcagagcctttacgtgaagggagagcccattatcaacttttatgatcctctggtcttcccctccgacgaatttgatgcctctatcagccaagtgaatgagaaaattaaccagtccctcgctttcatccggaagtctgacgaactgctgcacaatgtgaacgccggcaagagcacaaccaatattatgatcacgaccattatcattgttatcatcgtcattctcctgtcccttatcgccgtggggctgctcctgtactgcaaagctcgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6504 - RNA, 1834 nt, synthetic construct
  misc_feature 1..1834: note = mRNA product Design b-3 comprising derived and/or modified sequence from HRSV(A2)__F-del_DSCav1_mut6 (opt6)
  source 1..1834: mol_type = other RNA
gggagagtcccgcagtcggcgtccagcggctctgcttgttcgtgtgtgtgtcgttgcaggccttattcaagcttaccatggaactactcatattaaaagcaaacgcaataacaacgatattaacagctgtaacattctgctttgcatcaggccaaaatatcaccgaagaattttatcaaagcacatgctctgcagtatccaaaggatacttaggagcattaagaacaggctggtacacatccgtaataacaatagaactatcaaacatcaaagaaaacaaatgcaacggcacagacgccaaagtaaaactcataaaacaagaactagacaaatataaaaacgcagtaacagatctacaaatgctcatgtgctccacaccagcaaccggatctggttcagccatagcatccggcgtagccgtctgcaaagtattacacctcgaaggagaagtaaacaaaataaaatctgccctattatctacaaataaagccgtagtaagtctaagtaacggagtatcagtactaacatttaaagtcctagacctgaaaaactatatcgacaaacaactattaccaatactaaacaaacaatcctgttccatccctaacccagaaacagttatggaatttcaacaaaaaaataaccgccttttagaaataactagagaattttcagtaaacgcaggagttacaacaccagtatcaacatacatgctaacaaattcagaattattatcccttataaatgacatgcctatcacaaacgatcaaaaaaaattaatgtccaacaacgtacaaatagtaagacaacaatcatattccatcatgtgcatcataaaagaagaagtcctcgcatacgtagtgcaactaccactatacggagtcatagatacaccctgttggaaacttcacacatctccactatgcacaacaaacacgaaagaaggatccaacatatgcctaacacgaacagacagaggatggtattgcgacaacgctggaagtgtgagcttcttccctcaagcagaaacttgcaaagtatgcagcaatcgtgtattctgcgacacaatgaactcattaacactcccaagcgaagtaaacctctgcaatgtagacatctttaatccaaaatacgattgtaaaataatgacttcaaaaacagacgtctcatcatctgtaataacatctttaggagcaatagtttcttgctacggtaaaacaaaatgcaccgcatccaacaaaaacaaaggaataataaaaacattctctaacggctgcgattacgtatctaacaaaggagttgacacagtctcagtaggaaacacactatactacgtaaacaaacaagaaggacaaagcctatacgtaaaaggagaaccaataataaacttctatgacccattagtatttccaagcgatgaatttgacgcttcaatatcacaagtcaatgaaaaaataaatcagagcttagcattcataagaaaatctgatgaactactacacaatgtaaatgcaggaaaatccactaccaacataatgattaccacaattataatagttatcatagtaatactattatcactaatagccgttggattactactatactgcaaagcaagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6505 - RNA, 1834 nt, synthetic construct
  misc_feature 1..1834: note = mRNA product Design b-3 comprising derived and/or modified sequence from HRSV(A2)__F-del_DSCav1_mut6 (opt11)
  source 1..1834: mol_type = other RNA
gggagagtcccgcagtcggcgtccagcggctctgcttgttcgtgtgtgtgtcgttgcaggccttattcaagcttaccatggaactactcatcctaaaagcaaacgccatcaccaccatactaaccgccgtcaccttctgcttcgcctcgggacaaaacatcaccgaagagttctaccagtcaacgtgctccgccgtctcaaaaggctacctaggcgccctccgcaccgggtggtatacctccgtcataactatcgaactctctaacatcaaagaaaacaaatgtaacggcaccgacgccaaagtcaaactaatcaaacaagaactggacaaatacaaaaacgccgtcaccgacctacaaatgctcatgtgctccactccagccaccggctccggtagcgcaatcgcctcaggcgtagctgtatgcaaagtcctccacctagaaggcgaagtaaacaaaataaaatccgccctcctctcaaccaacaaggccgtcgtctcactctcaaacggcgtctccgtactcacctttaaagtcctagaccttaaaaactacatcgacaaacaactgctaccaatcctcaacaaacaatcatgcagcatcccaaacccggaaacagtcatggagttccaacagaaaaacaaccgactcctcgaaatcacccgcgagttctccgtcaacgccggagtcaccacacctgtaagcacatacatgcttactaattccgaactcctttcactaataaacgacatgccaataaccaacgaccaaaagaaactcatgtccaacaacgtacaaatcgtacgccaacaatcctactccatcatgtgcatcatcaaagaagaagtcctggcctatgtcgtacaactccccctttacggtgtcatcgacacaccctgctggaaactacacaccagccccctctgcacaacaaacaccaaagaaggctccaacatctgcctcacccgtaccgaccgaggctggtactgcgacaacgccggctccgtctccttcttcccccaagccgaaacctgcaaagtctgcagcaaccgcgtcttctgcgataccatgaactccctcacactcccatctgaagtcaacctctgcaacgtcgatattttcaatccaaaatacgactgcaaaatcatgactagcaaaaccgacgttagctcctccgtcatcacctccctcggcgccatagtttcatgctacggcaaaaccaaatgcaccgcctccaacaaaaacaaaggcatcataaaaaccttctccaacgggtgcgactacgtatctaataaaggagtcgacaccgtctcagtaggaaacaccctctactatgtcaacaaacaagaaggccaatcactatacgttaaaggcgaaccaatcatcaacttctacgacccactcgtcttccccagcgacgagtttgacgcctcaatctcgcaagtcaatgaaaagattaaccaatccctagccttcatccgaaaaagtgacgaactcctccacaacgttaacgccggcaaatctacaaccaacatcatgatcaccactataatcatcgtcatcatagtcatacttctcagcctcatcgcagtcggactcctcctttattgcaaggcacgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6506 - RNA, 1885 nt, synthetic construct
  misc_feature 1..1885: note = mRNA product Design b-4 comprising derived and/or modified sequence from HRSV(A2)__F-del_DSCav1_mut6 (opt1)
  source 1..1885: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaaccccgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6507 - RNA, 1885 nt, synthetic construct
  misc_feature 1..1885: note = mRNA product Design b-4 comprising derived and/or modified sequence from HRSV(A2)__F-del_DSCav1_mut6 (opt1)
  source 1..1885: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctcatgtgcagcacccccgccaccgggtccggcagcgccatcgcctccggcgtggcggtgtgcaaggtcctgcacctggagggggaggtgaacaagatcaagagcgccctcctgtccaccaacaaggccgtggtcagcctgtccaacggcgtgagcgtgctcacgttcaaggtcctggacctgaagaactacatcgacaagcagctcctgccgatcctgaacaagcagtcctgcagcatccccaaccccgagaccgtgatggagttccagcagaagaacaaccggctcctggagatcacccgcgagttctccgtgaacgccggggtcaccacgcccgtgagcacctacatgctgaccaactccgagctcctgagcctgatcaacgacatgccgatcaccaacgaccagaagaagctcatgagcaacaacgtgcagatcgtccggcagcagtcctacagcatcatgtgcatcatcaaggaggaggtgctggcctacgtggtccagctgcccctctacggcgtgatcgacacgccctgctggaagctgcacaccagccccctgtgcaccaccaacacgaaggaggggagcaacatctgcctcacccgcaccgaccggggctggtactgcgacaacgcgggctccgtgagcttcttcccgcaggccgagacctgcaaggtctgctccaaccgcgtgttctgcgacacgatgaacagcctgaccctgccctccgaggtcaacctctgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaacaaggggatcatcaagaccttctccaacggctgcgactacgtgagcaacaagggcgtcgacacggtgtccgtggggaacaccctgtactacgtcaacaagcaggagggccagagcctctacgtgaagggggagcccatcatcaacttctacgacccgctggtgttccccagcgacgagttcgacgcctccatcagccaggtcaacgagaagatcaaccagtccctggcgttcatccggaagtccgacgagctcctgcacaacgtgaacgccggcaagtccaccaccaacatcatgatcaccacgatcatcatcgtgatcatcgtcatcctgctcagcctgatcgccgtggggctgctcctgtactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6508 - RNA, 1885 nt, synthetic construct
  misc_feature 1..1885: note = mRNA product Design b-4 comprising derived and/or modified sequence from HRSV(A2)__F-del_DSCav1_mut6 (opt2)
  source 1..1885: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6509 - RNA, 1885 nt, synthetic construct
  misc_feature 1..1885: note = mRNA product Design b-4 comprising derived and/or modified sequence from HRSV(A2)__F-del_DSCav1_mut6 (opt3)
  source 1..1885: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagatgcttatgtgttccacacccgccaccgggtctggatcggctatagcatcaggcgtggccgtctgcaaggtgctgcacttggagggtgaggttaacaaaatcaagagcgctctcctgagtacgaataaagccgtggtctccctgtctaacggggtgagcgtactcacttttaaggttttagatctgaagaattacattgacaaacagcttttgcctatcctgaacaagcaatcctgttcaattccaaatccggaaaccgtgatggagttccagcagaaaaacaataggctactcgaaatcacacgggagtttagtgtcaacgcgggagtgactacccccgtgagcacatatatgctgaccaattctgagcttctgtccttgataaacgatatgcctattacgaacgaccagaagaaactcatgtcaaataacgtccaaatcgttcgccagcagagctacagtattatgtgcatcatcaaggaagaggtgctggcatatgtagtgcagttaccactgtacggcgtcattgatactccctgttggaaactccatacatctcctctttgcaccactaatacaaaggaaggctccaacatatgtctgacccgaacggaccgtgggtggtactgcgataatgccggaagcgtgtcgttctttccacaagctgagacctgtaaggtttgctctaacagagtgttctgcgacacaatgaactccttgactctaccctcagaagtcaatctgtgtaatgtggatatctttaaccctaaatatgactgcaagattatgaccagtaaaacagatgtaagctcctctgttatcactagcctcggtgccatagtgtcatgttacggcaagaccaaatgcacagcaagtaataagaacaaggggattatcaaaaccttctccaatggatgtgactatgtcagcaacaagggcgtggacactgtctctgtgggtaatacgctgtactatgttaacaaacaggaggggcagtcactttacgtgaagggagagccaatcattaacttttatgatccgctggtattccccagtgacgaatttgatgctagcatctcccaagtcaatgagaaaattaaccagtctttggccttcataaggaagtcggacgaactcctgcacaatgtgaacgcgggcaagagcacaaccaatatcatgattactaccatcatcattgttataatcgtgattttactgtccctaatcgccgtcggcctcctgctttactgcaaagcacggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6510 - RNA, 1885 nt, synthetic construct
  misc_feature 1..1885: note = mRNA product Design b-4 comprising derived and/or modified sequence from HRSV(A2)__F-del_DSCav1_mut6 (opt4)
  source 1..1885: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6511 - RNA, 1885 nt, synthetic construct
  misc_feature 1..1885: note = mRNA product Design b-4 comprising derived and/or modified sequence from HRSV(A2)__F-del_DSCav1_mut6 (opt5)
  source 1..1885: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagatgctgatgtgtagcacccccgccacaggatccggctctgctattgccagcggggtcgcggtgtgcaaggttctgcacctcgagggagaggtgaacaaaatcaagtccgccctgcttagcaccaataaagctgtcgtgtctctgtccaacggcgttagcgtgctcacatttaaggtcctggatcttaagaattacattgacaaacagctgctccctatcctgaacaagcaatcttgttccattccgaatcccgaaaccgtgatggagttccagcagaaaaacaatcggctgctcgaaatcacgcgcgagtttagcgtgaacgccggcgtcacaacccctgtttctacatatatgctgaccaattccgagcttctgagcctcattaacgatatgcccatcaccaacgaccagaagaaactgatgtccaataacgtgcaaatcgtgagacagcagtcttacagcattatgtgcatcattaaggaagaggtccttgcttatgtggttcagctgcctctctacggggtgatcgatacaccctgttggaaactgcatacgtcccctctgtgcaccacaaataccaaggaaggaagcaacatttgtctcacacggaccgaccgcggctggtactgcgataatgccgggtctgtctccttctttccgcaagcggagacgtgtaaggtgtgcagcaacagagttttctgcgacacaatgaactctctgacccttcccagcgaagtgaatctgtgtaatgtcgatatctttaaccctaaatatgactgcaagatcatgacctccaaaacagatgtgtctagctccgtcattaccagcctcggagccatcgtgtcttgttacggcaagacaaaatgcacggcttccaataagaacaaggggattatcaaaaccttcagcaatggatgtgactatgtttctaacaagggcgtggacacagtctccgtgggcaataccctgtactatgttaacaaacaggaggggcagagcctttacgtgaagggagagcccattatcaacttttatgatcctctggtcttcccctccgacgaatttgatgcctctatcagccaagtgaatgagaaaattaaccagtccctcgctttcatccggaagtctgacgaactgctgcacaatgtgaacgccggcaagagcacaaccaatattatgatcacgaccattatcattgttatcatcgtcattctcctgtcccttatcgccgtggggctgctcctgtactgcaaagctcgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6512 - RNA, 1885 nt, synthetic construct
  misc_feature 1..1885: note = mRNA product Design b-4 comprising derived and/or modified sequence from HRSV(A2)__F-del_DSCav1_mut6 (opt6)
  source 1..1885: mol_type = other RNA
gggagagtcccgcagtcggcgtccagcggctctgcttgttcgtgtgtgtgtcgttgcaggccttattcaagcttaccatggaactactcatattaaaagcaaacgcaataacaacgatattaacagctgtaacattctgctttgcatcaggccaaaatatcaccgaagaattttatcaaagcacatgctctgcagtatccaaaggatacttaggagcattaagaacaggctggtacacatccgtaataacaatagaactatcaaacatcaaagaaaacaaatgcaacggcacagacgccaaagtaaaactcataaaacaagaactagacaaatataaaaacgcagtaacagatctacaaatgctcatgtgctccacaccagcaaccggatctggttcagccatagcatccggcgtagccgtctgcaaagtattacacctcgaaggagaagtaaacaaaataaaatctgccctattatctacaaataaagccgtagtaagtctaagtaacggagtatcagtactaacatttaaagtcctagacctgaaaaactatatcgacaaacaactattaccaatactaaacaaacaatcctgttccatccctaacccagaaacagttatggaatttcaacaaaaaaataaccgccttttagaaataactagagaattttcagtaaacgcaggagttacaacaccagtatcaacatacatgctaacaaattcagaattattatcccttataaatgacatgcctatcacaaacgatcaaaaaaaattaatgtccaacaacgtacaaatagtaagacaacaatcatattccatcatgtgcatcataaaagaagaagtcctcgcatacgtagtgcaactaccactatacggagtcatagatacaccctgttggaaacttcacacatctccactatgcacaacaaacacgaaagaaggatccaacatatgcctaacacgaacagacagaggatggtattgcgacaacgctggaagtgtgagcttcttccctcaagcagaaacttgcaaagtatgcagcaatcgtgtattctgcgacacaatgaactcattaacactcccaagcgaagtaaacctctgcaatgtagacatctttaatccaaaatacgattgtaaaataatgacttcaaaaacagacgtctcatcatctgtaataacatctttaggagcaatagtttcttgctacggtaaaacaaaatgcaccgcatccaacaaaaacaaaggaataataaaaacattctctaacggctgcgattacgtatctaacaaaggagttgacacagtctcagtaggaaacacactatactacgtaaacaaacaagaaggacaaagcctatacgtaaaaggagaaccaataataaacttctatgacccattagtatttccaagcgatgaatttgacgcttcaatatcacaagtcaatgaaaaaataaatcagagcttagcattcataagaaaatctgatgaactactacacaatgtaaatgcaggaaaatccactaccaacataatgattaccacaattataatagttatcatagtaatactattatcactaatagccgttggattactactatactgcaaagcaagataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6513 - RNA, 1885 nt, synthetic construct
  misc_feature 1..1885: note = mRNA product Design b-4 comprising derived and/or modified sequence from HRSV(A2)__F-del_DSCav1_mut6 (opt11)
  source 1..1885: mol_type = other RNA
gggagagtcccgcagtcggcgtccagcggctctgcttgttcgtgtgtgtgtcgttgcaggccttattcaagcttaccatggaactactcatcctaaaagcaaacgccatcaccaccatactaaccgccgtcaccttctgcttcgcctcgggacaaaacatcaccgaagagttctaccagtcaacgtgctccgccgtctcaaaaggctacctaggcgccctccgcaccgggtggtatacctccgtcataactatcgaactctctaacatcaaagaaaacaaatgtaacggcaccgacgccaaagtcaaactaatcaaacaagaactggacaaatacaaaaacgccgtcaccgacctacaaatgctcatgtgctccactccagccaccggctccggtagcgcaatcgcctcaggcgtagctgtatgcaaagtcctccacctagaaggcgaagtaaacaaaataaaatccgccctcctctcaaccaacaaggccgtcgtctcactctcaaacggcgtctccgtactcacctttaaagtcctagaccttaaaaactacatcgacaaacaactgctaccaatcctcaacaaacaatcatgcagcatcccaaacccggaaacagtcatggagttccaacagaaaaacaaccgactcctcgaaatcacccgcgagttctccgtcaacgccggagtcaccacacctgtaagcacatacatgcttactaattccgaactcctttcactaataaacgacatgccaataaccaacgaccaaaagaaactcatgtccaacaacgtacaaatcgtacgccaacaatcctactccatcatgtgcatcatcaaagaagaagtcctggcctatgtcgtacaactccccctttacggtgtcatcgacacaccctgctggaaactacacaccagccccctctgcacaacaaacaccaaagaaggctccaacatctgcctcacccgtaccgaccgaggctggtactgcgacaacgccggctccgtctccttcttcccccaagccgaaacctgcaaagtctgcagcaaccgcgtcttctgcgataccatgaactccctcacactcccatctgaagtcaacctctgcaacgtcgatattttcaatccaaaatacgactgcaaaatcatgactagcaaaaccgacgttagctcctccgtcatcacctccctcggcgccatagtttcatgctacggcaaaaccaaatgcaccgcctccaacaaaaacaaaggcatcataaaaaccttctccaacgggtgcgactacgtatctaataaaggagtcgacaccgtctcagtaggaaacaccctctactatgtcaacaaacaagaaggccaatcactatacgttaaaggcgaaccaatcatcaacttctacgacccactcgtcttccccagcgacgagtttgacgcctcaatctcgcaagtcaatgaaaagattaaccaatccctagccttcatccgaaaaagtgacgaactcctccacaacgttaacgccggcaaatctacaaccaacatcatgatcaccactataatcatcgtcatcatagtcatacttctcagcctcatcgcagtcggactcctcctttattgcaaggcacgataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6514 - RNA, 1947 nt, synthetic construct
  misc_feature 1..1947: note = mRNA product Design b-5 comprising derived and/or modified sequence from HRSV(A2)__F-del_DSCav1_mut6 (opt1)
  source 1..1947: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaaccccgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6515 - RNA, 1947 nt, synthetic construct
  misc_feature 1..1947: note = mRNA product Design b-5 comprising derived and/or modified sequence from HRSV(A2)__F-del_DSCav1_mut6 (opt1)
  source 1..1947: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctcatgtgcagcacccccgccaccgggtccggcagcgccatcgcctccggcgtggcggtgtgcaaggtcctgcacctggagggggaggtgaacaagatcaagagcgccctcctgtccaccaacaaggccgtggtcagcctgtccaacggcgtgagcgtgctcacgttcaaggtcctggacctgaagaactacatcgacaagcagctcctgccgatcctgaacaagcagtcctgcagcatccccaaccccgagaccgtgatggagttccagcagaagaacaaccggctcctggagatcacccgcgagttctccgtgaacgccggggtcaccacgcccgtgagcacctacatgctgaccaactccgagctcctgagcctgatcaacgacatgccgatcaccaacgaccagaagaagctcatgagcaacaacgtgcagatcgtccggcagcagtcctacagcatcatgtgcatcatcaaggaggaggtgctggcctacgtggtccagctgcccctctacggcgtgatcgacacgccctgctggaagctgcacaccagccccctgtgcaccaccaacacgaaggaggggagcaacatctgcctcacccgcaccgaccggggctggtactgcgacaacgcgggctccgtgagcttcttcccgcaggccgagacctgcaaggtctgctccaaccgcgtgttctgcgacacgatgaacagcctgaccctgccctccgaggtcaacctctgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaacaaggggatcatcaagaccttctccaacggctgcgactacgtgagcaacaagggcgtcgacacggtgtccgtggggaacaccctgtactacgtcaacaagcaggagggccagagcctctacgtgaagggggagcccatcatcaacttctacgacccgctggtgttccccagcgacgagttcgacgcctccatcagccaggtcaacgagaagatcaaccagtccctggcgttcatccggaagtccgacgagctcctgcacaacgtgaacgccggcaagtccaccaccaacatcatgatcaccacgatcatcatcgtgatcatcgtcatcctgctcagcctgatcgccgtggggctgctcctgtactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6516 - RNA, 1947 nt, synthetic construct
  misc_feature 1..1947: note = mRNA product Design b-5 comprising derived and/or modified sequence from HRSV(A2)__F-del_DSCav1_mut6 (opt2)
  source 1..1947: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6517 - RNA, 1947 nt, synthetic construct
  misc_feature 1..1947: note = mRNA product Design b-5 comprising derived and/or modified sequence from HRSV(A2)__F-del_DSCav1_mut6 (opt3)
  source 1..1947: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagatgcttatgtgttccacacccgccaccgggtctggatcggctatagcatcaggcgtggccgtctgcaaggtgctgcacttggagggtgaggttaacaaaatcaagagcgctctcctgagtacgaataaagccgtggtctccctgtctaacggggtgagcgtactcacttttaaggttttagatctgaagaattacattgacaaacagcttttgcctatcctgaacaagcaatcctgttcaattccaaatccggaaaccgtgatggagttccagcagaaaaacaataggctactcgaaatcacacgggagtttagtgtcaacgcgggagtgactacccccgtgagcacatatatgctgaccaattctgagcttctgtccttgataaacgatatgcctattacgaacgaccagaagaaactcatgtcaaataacgtccaaatcgttcgccagcagagctacagtattatgtgcatcatcaaggaagaggtgctggcatatgtagtgcagttaccactgtacggcgtcattgatactccctgttggaaactccatacatctcctctttgcaccactaatacaaaggaaggctccaacatatgtctgacccgaacggaccgtgggtggtactgcgataatgccggaagcgtgtcgttctttccacaagctgagacctgtaaggtttgctctaacagagtgttctgcgacacaatgaactccttgactctaccctcagaagtcaatctgtgtaatgtggatatctttaaccctaaatatgactgcaagattatgaccagtaaaacagatgtaagctcctctgttatcactagcctcggtgccatagtgtcatgttacggcaagaccaaatgcacagcaagtaataagaacaaggggattatcaaaaccttctccaatggatgtgactatgtcagcaacaagggcgtggacactgtctctgtgggtaatacgctgtactatgttaacaaacaggaggggcagtcactttacgtgaagggagagccaatcattaacttttatgatccgctggtattccccagtgacgaatttgatgctagcatctcccaagtcaatgagaaaattaaccagtctttggccttcataaggaagtcggacgaactcctgcacaatgtgaacgcgggcaagagcacaaccaatatcatgattactaccatcatcattgttataatcgtgattttactgtccctaatcgccgtcggcctcctgctttactgcaaagcacggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6518 - RNA, 1947 nt, synthetic construct
  misc_feature 1..1947: note = mRNA product Design b-5 comprising derived and/or modified sequence from HRSV(A2)__F-del_DSCav1_mut6 (opt4)
  source 1..1947: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6519 - RNA, 1947 nt, synthetic construct
  misc_feature 1..1947: note = mRNA product Design b-5 comprising derived and/or modified sequence from HRSV(A2)__F-del_DSCav1_mut6 (opt5)
  source 1..1947: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagatgctgatgtgtagcacccccgccacaggatccggctctgctattgccagcggggtcgcggtgtgcaaggttctgcacctcgagggagaggtgaacaaaatcaagtccgccctgcttagcaccaataaagctgtcgtgtctctgtccaacggcgttagcgtgctcacatttaaggtcctggatcttaagaattacattgacaaacagctgctccctatcctgaacaagcaatcttgttccattccgaatcccgaaaccgtgatggagttccagcagaaaaacaatcggctgctcgaaatcacgcgcgagtttagcgtgaacgccggcgtcacaacccctgtttctacatatatgctgaccaattccgagcttctgagcctcattaacgatatgcccatcaccaacgaccagaagaaactgatgtccaataacgtgcaaatcgtgagacagcagtcttacagcattatgtgcatcattaaggaagaggtccttgcttatgtggttcagctgcctctctacggggtgatcgatacaccctgttggaaactgcatacgtcccctctgtgcaccacaaataccaaggaaggaagcaacatttgtctcacacggaccgaccgcggctggtactgcgataatgccgggtctgtctccttctttccgcaagcggagacgtgtaaggtgtgcagcaacagagttttctgcgacacaatgaactctctgacccttcccagcgaagtgaatctgtgtaatgtcgatatctttaaccctaaatatgactgcaagatcatgacctccaaaacagatgtgtctagctccgtcattaccagcctcggagccatcgtgtcttgttacggcaagacaaaatgcacggcttccaataagaacaaggggattatcaaaaccttcagcaatggatgtgactatgtttctaacaagggcgtggacacagtctccgtgggcaataccctgtactatgttaacaaacaggaggggcagagcctttacgtgaagggagagcccattatcaacttttatgatcctctggtcttcccctccgacgaatttgatgcctctatcagccaagtgaatgagaaaattaaccagtccctcgctttcatccggaagtctgacgaactgctgcacaatgtgaacgccggcaagagcacaaccaatattatgatcacgaccattatcattgttatcatcgtcattctcctgtcccttatcgccgtggggctgctcctgtactgcaaagctcgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6520 - RNA, 1947 nt, synthetic construct
  misc_feature 1..1947: note = mRNA product Design b-5 comprising derived and/or modified sequence from HRSV(A2)__F-del_DSCav1_mut6 (opt6)
  source 1..1947: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactactcatattaaaagcaaacgcaataacaacgatattaacagctgtaacattctgctttgcatcaggccaaaatatcaccgaagaattttatcaaagcacatgctctgcagtatccaaaggatacttaggagcattaagaacaggctggtacacatccgtaataacaatagaactatcaaacatcaaagaaaacaaatgcaacggcacagacgccaaagtaaaactcataaaacaagaactagacaaatataaaaacgcagtaacagatctacaaatgctcatgtgctccacaccagcaaccggatctggttcagccatagcatccggcgtagccgtctgcaaagtattacacctcgaaggagaagtaaacaaaataaaatctgccctattatctacaaataaagccgtagtaagtctaagtaacggagtatcagtactaacatttaaagtcctagacctgaaaaactatatcgacaaacaactattaccaatactaaacaaacaatcctgttccatccctaacccagaaacagttatggaatttcaacaaaaaaataaccgccttttagaaataactagagaattttcagtaaacgcaggagttacaacaccagtatcaacatacatgctaacaaattcagaattattatcccttataaatgacatgcctatcacaaacgatcaaaaaaaattaatgtccaacaacgtacaaatagtaagacaacaatcatattccatcatgtgcatcataaaagaagaagtcctcgcatacgtagtgcaactaccactatacggagtcatagatacaccctgttggaaacttcacacatctccactatgcacaacaaacacgaaagaaggatccaacatatgcctaacacgaacagacagaggatggtattgcgacaacgctggaagtgtgagcttcttccctcaagcagaaacttgcaaagtatgcagcaatcgtgtattctgcgacacaatgaactcattaacactcccaagcgaagtaaacctctgcaatgtagacatctttaatccaaaatacgattgtaaaataatgacttcaaaaacagacgtctcatcatctgtaataacatctttaggagcaatagtttcttgctacggtaaaacaaaatgcaccgcatccaacaaaaacaaaggaataataaaaacattctctaacggctgcgattacgtatctaacaaaggagttgacacagtctcagtaggaaacacactatactacgtaaacaaacaagaaggacaaagcctatacgtaaaaggagaaccaataataaacttctatgacccattagtatttccaagcgatgaatttgacgcttcaatatcacaagtcaatgaaaaaataaatcagagcttagcattcataagaaaatctgatgaactactacacaatgtaaatgcaggaaaatccactaccaacataatgattaccacaattataatagttatcatagtaatactattatcactaatagccgttggattactactatactgcaaagcaagataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6521 - RNA, 1947 nt, synthetic construct
  misc_feature 1..1947: note = mRNA product Design b-5 comprising derived and/or modified sequence from HRSV(A2)__F-del_DSCav1_mut6 (opt11)
  source 1..1947: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactactcatcctaaaagcaaacgccatcaccaccatactaaccgccgtcaccttctgcttcgcctcgggacaaaacatcaccgaagagttctaccagtcaacgtgctccgccgtctcaaaaggctacctaggcgccctccgcaccgggtggtatacctccgtcataactatcgaactctctaacatcaaagaaaacaaatgtaacggcaccgacgccaaagtcaaactaatcaaacaagaactggacaaatacaaaaacgccgtcaccgacctacaaatgctcatgtgctccactccagccaccggctccggtagcgcaatcgcctcaggcgtagctgtatgcaaagtcctccacctagaaggcgaagtaaacaaaataaaatccgccctcctctcaaccaacaaggccgtcgtctcactctcaaacggcgtctccgtactcacctttaaagtcctagaccttaaaaactacatcgacaaacaactgctaccaatcctcaacaaacaatcatgcagcatcccaaacccggaaacagtcatggagttccaacagaaaaacaaccgactcctcgaaatcacccgcgagttctccgtcaacgccggagtcaccacacctgtaagcacatacatgcttactaattccgaactcctttcactaataaacgacatgccaataaccaacgaccaaaagaaactcatgtccaacaacgtacaaatcgtacgccaacaatcctactccatcatgtgcatcatcaaagaagaagtcctggcctatgtcgtacaactccccctttacggtgtcatcgacacaccctgctggaaactacacaccagccccctctgcacaacaaacaccaaagaaggctccaacatctgcctcacccgtaccgaccgaggctggtactgcgacaacgccggctccgtctccttcttcccccaagccgaaacctgcaaagtctgcagcaaccgcgtcttctgcgataccatgaactccctcacactcccatctgaagtcaacctctgcaacgtcgatattttcaatccaaaatacgactgcaaaatcatgactagcaaaaccgacgttagctcctccgtcatcacctccctcggcgccatagtttcatgctacggcaaaaccaaatgcaccgcctccaacaaaaacaaaggcatcataaaaaccttctccaacgggtgcgactacgtatctaataaaggagtcgacaccgtctcagtaggaaacaccctctactatgtcaacaaacaagaaggccaatcactatacgttaaaggcgaaccaatcatcaacttctacgacccactcgtcttccccagcgacgagtttgacgcctcaatctcgcaagtcaatgaaaagattaaccaatccctagccttcatccgaaaaagtgacgaactcctccacaacgttaacgccggcaaatctacaaccaacatcatgatcaccactataatcatcgtcatcatagtcatacttctcagcctcatcgcagtcggactcctcctttattgcaaggcacgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6522 - RNA, 1853 nt, synthetic construct
  misc_feature 1..1853: note = mRNA product Design c-1 comprising derived and/or modified sequence from HRSV(A2)__F-del_DSCav1_mut6 (opt1)
  source 1..1853: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaaccccgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6523 - RNA, 1853 nt, synthetic construct
  misc_feature 1..1853: note = mRNA product Design c-1 comprising derived and/or modified sequence from HRSV(A2)__F-del_DSCav1_mut6 (opt1)
  source 1..1853: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctcatgtgcagcacccccgccaccgggtccggcagcgccatcgcctccggcgtggcggtgtgcaaggtcctgcacctggagggggaggtgaacaagatcaagagcgccctcctgtccaccaacaaggccgtggtcagcctgtccaacggcgtgagcgtgctcacgttcaaggtcctggacctgaagaactacatcgacaagcagctcctgccgatcctgaacaagcagtcctgcagcatccccaaccccgagaccgtgatggagttccagcagaagaacaaccggctcctggagatcacccgcgagttctccgtgaacgccggggtcaccacgcccgtgagcacctacatgctgaccaactccgagctcctgagcctgatcaacgacatgccgatcaccaacgaccagaagaagctcatgagcaacaacgtgcagatcgtccggcagcagtcctacagcatcatgtgcatcatcaaggaggaggtgctggcctacgtggtccagctgcccctctacggcgtgatcgacacgccctgctggaagctgcacaccagccccctgtgcaccaccaacacgaaggaggggagcaacatctgcctcacccgcaccgaccggggctggtactgcgacaacgcgggctccgtgagcttcttcccgcaggccgagacctgcaaggtctgctccaaccgcgtgttctgcgacacgatgaacagcctgaccctgccctccgaggtcaacctctgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaacaaggggatcatcaagaccttctccaacggctgcgactacgtgagcaacaagggcgtcgacacggtgtccgtggggaacaccctgtactacgtcaacaagcaggagggccagagcctctacgtgaagggggagcccatcatcaacttctacgacccgctggtgttccccagcgacgagttcgacgcctccatcagccaggtcaacgagaagatcaaccagtccctggcgttcatccggaagtccgacgagctcctgcacaacgtgaacgccggcaagtccaccaccaacatcatgatcaccacgatcatcatcgtgatcatcgtcatcctgctcagcctgatcgccgtggggctgctcctgtactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6524 - RNA, 1853 nt, synthetic construct
  misc_feature 1..1853: note = mRNA product Design c-1 comprising derived and/or modified sequence from HRSV(A2)__F-del_DSCav1_mut6 (opt2)
  source 1..1853: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6525 - RNA, 1853 nt, synthetic construct
  misc_feature 1..1853: note = mRNA product Design c-1 comprising derived and/or modified sequence from HRSV(A2)__F-del_DSCav1_mut6 (opt3)
  source 1..1853: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagatgcttatgtgttccacacccgccaccgggtctggatcggctatagcatcaggcgtggccgtctgcaaggtgctgcacttggagggtgaggttaacaaaatcaagagcgctctcctgagtacgaataaagccgtggtctccctgtctaacggggtgagcgtactcacttttaaggttttagatctgaagaattacattgacaaacagcttttgcctatcctgaacaagcaatcctgttcaattccaaatccggaaaccgtgatggagttccagcagaaaaacaataggctactcgaaatcacacgggagtttagtgtcaacgcgggagtgactacccccgtgagcacatatatgctgaccaattctgagcttctgtccttgataaacgatatgcctattacgaacgaccagaagaaactcatgtcaaataacgtccaaatcgttcgccagcagagctacagtattatgtgcatcatcaaggaagaggtgctggcatatgtagtgcagttaccactgtacggcgtcattgatactccctgttggaaactccatacatctcctctttgcaccactaatacaaaggaaggctccaacatatgtctgacccgaacggaccgtgggtggtactgcgataatgccggaagcgtgtcgttctttccacaagctgagacctgtaaggtttgctctaacagagtgttctgcgacacaatgaactccttgactctaccctcagaagtcaatctgtgtaatgtggatatctttaaccctaaatatgactgcaagattatgaccagtaaaacagatgtaagctcctctgttatcactagcctcggtgccatagtgtcatgttacggcaagaccaaatgcacagcaagtaataagaacaaggggattatcaaaaccttctccaatggatgtgactatgtcagcaacaagggcgtggacactgtctctgtgggtaatacgctgtactatgttaacaaacaggaggggcagtcactttacgtgaagggagagccaatcattaacttttatgatccgctggtattccccagtgacgaatttgatgctagcatctcccaagtcaatgagaaaattaaccagtctttggccttcataaggaagtcggacgaactcctgcacaatgtgaacgcgggcaagagcacaaccaatatcatgattactaccatcatcattgttataatcgtgattttactgtccctaatcgccgtcggcctcctgctttactgcaaagcacggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6526 - RNA, 1853 nt, synthetic construct
  misc_feature 1..1853: note = mRNA product Design c-1 comprising derived and/or modified sequence from HRSV(A2)__F-del_DSCav1_mut6 (opt4)
  source 1..1853: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6527 - RNA, 1853 nt, synthetic construct
  misc_feature 1..1853: note = mRNA product Design c-1 comprising derived and/or modified sequence from HRSV(A2)__F-del_DSCav1_mut6 (opt5)
  source 1..1853: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagatgctgatgtgtagcacccccgccacaggatccggctctgctattgccagcggggtcgcggtgtgcaaggttctgcacctcgagggagaggtgaacaaaatcaagtccgccctgcttagcaccaataaagctgtcgtgtctctgtccaacggcgttagcgtgctcacatttaaggtcctggatcttaagaattacattgacaaacagctgctccctatcctgaacaagcaatcttgttccattccgaatcccgaaaccgtgatggagttccagcagaaaaacaatcggctgctcgaaatcacgcgcgagtttagcgtgaacgccggcgtcacaacccctgtttctacatatatgctgaccaattccgagcttctgagcctcattaacgatatgcccatcaccaacgaccagaagaaactgatgtccaataacgtgcaaatcgtgagacagcagtcttacagcattatgtgcatcattaaggaagaggtccttgcttatgtggttcagctgcctctctacggggtgatcgatacaccctgttggaaactgcatacgtcccctctgtgcaccacaaataccaaggaaggaagcaacatttgtctcacacggaccgaccgcggctggtactgcgataatgccgggtctgtctccttctttccgcaagcggagacgtgtaaggtgtgcagcaacagagttttctgcgacacaatgaactctctgacccttcccagcgaagtgaatctgtgtaatgtcgatatctttaaccctaaatatgactgcaagatcatgacctccaaaacagatgtgtctagctccgtcattaccagcctcggagccatcgtgtcttgttacggcaagacaaaatgcacggcttccaataagaacaaggggattatcaaaaccttcagcaatggatgtgactatgtttctaacaagggcgtggacacagtctccgtgggcaataccctgtactatgttaacaaacaggaggggcagagcctttacgtgaagggagagcccattatcaacttttatgatcctctggtcttcccctccgacgaatttgatgcctctatcagccaagtgaatgagaaaattaaccagtccctcgctttcatccggaagtctgacgaactgctgcacaatgtgaacgccggcaagagcacaaccaatattatgatcacgaccattatcattgttatcatcgtcattctcctgtcccttatcgccgtggggctgctcctgtactgcaaagctcgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6528 - RNA, 1853 nt, synthetic construct
  misc_feature 1..1853: note = mRNA product Design c-1 comprising derived and/or modified sequence from HRSV(A2)__F-del_DSCav1_mut6 (opt6)
  source 1..1853: mol_type = other RNA
gggagagtccgctcagccaggttgcagaagcggcttagcgtgtgtcctaatcttctctctgcgtgtaggtaggcctgtgccgcaaacaagcttaccatggaactactcatattaaaagcaaacgcaataacaacgatattaacagctgtaacattctgctttgcatcaggccaaaatatcaccgaagaattttatcaaagcacatgctctgcagtatccaaaggatacttaggagcattaagaacaggctggtacacatccgtaataacaatagaactatcaaacatcaaagaaaacaaatgcaacggcacagacgccaaagtaaaactcataaaacaagaactagacaaatataaaaacgcagtaacagatctacaaatgctcatgtgctccacaccagcaaccggatctggttcagccatagcatccggcgtagccgtctgcaaagtattacacctcgaaggagaagtaaacaaaataaaatctgccctattatctacaaataaagccgtagtaagtctaagtaacggagtatcagtactaacatttaaagtcctagacctgaaaaactatatcgacaaacaactattaccaatactaaacaaacaatcctgttccatccctaacccagaaacagttatggaatttcaacaaaaaaataaccgccttttagaaataactagagaattttcagtaaacgcaggagttacaacaccagtatcaacatacatgctaacaaattcagaattattatcccttataaatgacatgcctatcacaaacgatcaaaaaaaattaatgtccaacaacgtacaaatagtaagacaacaatcatattccatcatgtgcatcataaaagaagaagtcctcgcatacgtagtgcaactaccactatacggagtcatagatacaccctgttggaaacttcacacatctccactatgcacaacaaacacgaaagaaggatccaacatatgcctaacacgaacagacagaggatggtattgcgacaacgctggaagtgtgagcttcttccctcaagcagaaacttgcaaagtatgcagcaatcgtgtattctgcgacacaatgaactcattaacactcccaagcgaagtaaacctctgcaatgtagacatctttaatccaaaatacgattgtaaaataatgacttcaaaaacagacgtctcatcatctgtaataacatctttaggagcaatagtttcttgctacggtaaaacaaaatgcaccgcatccaacaaaaacaaaggaataataaaaacattctctaacggctgcgattacgtatctaacaaaggagttgacacagtctcagtaggaaacacactatactacgtaaacaaacaagaaggacaaagcctatacgtaaaaggagaaccaataataaacttctatgacccattagtatttccaagcgatgaatttgacgcttcaatatcacaagtcaatgaaaaaataaatcagagcttagcattcataagaaaatctgatgaactactacacaatgtaaatgcaggaaaatccactaccaacataatgattaccacaattataatagttatcatagtaatactattatcactaatagccgttggattactactatactgcaaagcaagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6529 - RNA, 1853 nt, synthetic construct
  misc_feature 1..1853: note = mRNA product Design c-1 comprising derived and/or modified sequence from HRSV(A2)__F-del_DSCav1_mut6 (opt11)
  source 1..1853: mol_type = other RNA
gggagagtccgctcagccaggttgcagaagcggcttagcgtgtgtcctaatcttctctctgcgtgtaggtaggcctgtgccgcaaacaagcttaccatggaactactcatcctaaaagcaaacgccatcaccaccatactaaccgccgtcaccttctgcttcgcctcgggacaaaacatcaccgaagagttctaccagtcaacgtgctccgccgtctcaaaaggctacctaggcgccctccgcaccgggtggtatacctccgtcataactatcgaactctctaacatcaaagaaaacaaatgtaacggcaccgacgccaaagtcaaactaatcaaacaagaactggacaaatacaaaaacgccgtcaccgacctacaaatgctcatgtgctccactccagccaccggctccggtagcgcaatcgcctcaggcgtagctgtatgcaaagtcctccacctagaaggcgaagtaaacaaaataaaatccgccctcctctcaaccaacaaggccgtcgtctcactctcaaacggcgtctccgtactcacctttaaagtcctagaccttaaaaactacatcgacaaacaactgctaccaatcctcaacaaacaatcatgcagcatcccaaacccggaaacagtcatggagttccaacagaaaaacaaccgactcctcgaaatcacccgcgagttctccgtcaacgccggagtcaccacacctgtaagcacatacatgcttactaattccgaactcctttcactaataaacgacatgccaataaccaacgaccaaaagaaactcatgtccaacaacgtacaaatcgtacgccaacaatcctactccatcatgtgcatcatcaaagaagaagtcctggcctatgtcgtacaactccccctttacggtgtcatcgacacaccctgctggaaactacacaccagccccctctgcacaacaaacaccaaagaaggctccaacatctgcctcacccgtaccgaccgaggctggtactgcgacaacgccggctccgtctccttcttcccccaagccgaaacctgcaaagtctgcagcaaccgcgtcttctgcgataccatgaactccctcacactcccatctgaagtcaacctctgcaacgtcgatattttcaatccaaaatacgactgcaaaatcatgactagcaaaaccgacgttagctcctccgtcatcacctccctcggcgccatagtttcatgctacggcaaaaccaaatgcaccgcctccaacaaaaacaaaggcatcataaaaaccttctccaacgggtgcgactacgtatctaataaaggagtcgacaccgtctcagtaggaaacaccctctactatgtcaacaaacaagaaggccaatcactatacgttaaaggcgaaccaatcatcaacttctacgacccactcgtcttccccagcgacgagtttgacgcctcaatctcgcaagtcaatgaaaagattaaccaatccctagccttcatccgaaaaagtgacgaactcctccacaacgttaacgccggcaaatctacaaccaacatcatgatcaccactataatcatcgtcatcatagtcatacttctcagcctcatcgcagtcggactcctcctttattgcaaggcacgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6530 - RNA, 1943 nt, synthetic construct
  misc_feature 1..1943: note = mRNA product Design c-2 comprising derived and/or modified sequence from HRSV(A2)__F-del_DSCav1_mut6 (opt1)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaaccccgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6531 - RNA, 1943 nt, synthetic construct
  misc_feature 1..1943: note = mRNA product Design c-2 comprising derived and/or modified sequence from HRSV(A2)__F-del_DSCav1_mut6 (opt1)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctcatgtgcagcacccccgccaccgggtccggcagcgccatcgcctccggcgtggcggtgtgcaaggtcctgcacctggagggggaggtgaacaagatcaagagcgccctcctgtccaccaacaaggccgtggtcagcctgtccaacggcgtgagcgtgctcacgttcaaggtcctggacctgaagaactacatcgacaagcagctcctgccgatcctgaacaagcagtcctgcagcatccccaaccccgagaccgtgatggagttccagcagaagaacaaccggctcctggagatcacccgcgagttctccgtgaacgccggggtcaccacgcccgtgagcacctacatgctgaccaactccgagctcctgagcctgatcaacgacatgccgatcaccaacgaccagaagaagctcatgagcaacaacgtgcagatcgtccggcagcagtcctacagcatcatgtgcatcatcaaggaggaggtgctggcctacgtggtccagctgcccctctacggcgtgatcgacacgccctgctggaagctgcacaccagccccctgtgcaccaccaacacgaaggaggggagcaacatctgcctcacccgcaccgaccggggctggtactgcgacaacgcgggctccgtgagcttcttcccgcaggccgagacctgcaaggtctgctccaaccgcgtgttctgcgacacgatgaacagcctgaccctgccctccgaggtcaacctctgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaacaaggggatcatcaagaccttctccaacggctgcgactacgtgagcaacaagggcgtcgacacggtgtccgtggggaacaccctgtactacgtcaacaagcaggagggccagagcctctacgtgaagggggagcccatcatcaacttctacgacccgctggtgttccccagcgacgagttcgacgcctccatcagccaggtcaacgagaagatcaaccagtccctggcgttcatccggaagtccgacgagctcctgcacaacgtgaacgccggcaagtccaccaccaacatcatgatcaccacgatcatcatcgtgatcatcgtcatcctgctcagcctgatcgccgtggggctgctcctgtactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6532 - RNA, 1943 nt, synthetic construct
  misc_feature 1..1943: note = mRNA product Design c-2 comprising derived and/or modified sequence from HRSV(A2)__F-del_DSCav1_mut6 (opt2)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6533 - RNA, 1943 nt, synthetic construct
  misc_feature 1..1943: note = mRNA product Design c-2 comprising derived and/or modified sequence from HRSV(A2)__F-del_DSCav1_mut6 (opt3)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagatgcttatgtgttccacacccgccaccgggtctggatcggctatagcatcaggcgtggccgtctgcaaggtgctgcacttggagggtgaggttaacaaaatcaagagcgctctcctgagtacgaataaagccgtggtctccctgtctaacggggtgagcgtactcacttttaaggttttagatctgaagaattacattgacaaacagcttttgcctatcctgaacaagcaatcctgttcaattccaaatccggaaaccgtgatggagttccagcagaaaaacaataggctactcgaaatcacacgggagtttagtgtcaacgcgggagtgactacccccgtgagcacatatatgctgaccaattctgagcttctgtccttgataaacgatatgcctattacgaacgaccagaagaaactcatgtcaaataacgtccaaatcgttcgccagcagagctacagtattatgtgcatcatcaaggaagaggtgctggcatatgtagtgcagttaccactgtacggcgtcattgatactccctgttggaaactccatacatctcctctttgcaccactaatacaaaggaaggctccaacatatgtctgacccgaacggaccgtgggtggtactgcgataatgccggaagcgtgtcgttctttccacaagctgagacctgtaaggtttgctctaacagagtgttctgcgacacaatgaactccttgactctaccctcagaagtcaatctgtgtaatgtggatatctttaaccctaaatatgactgcaagattatgaccagtaaaacagatgtaagctcctctgttatcactagcctcggtgccatagtgtcatgttacggcaagaccaaatgcacagcaagtaataagaacaaggggattatcaaaaccttctccaatggatgtgactatgtcagcaacaagggcgtggacactgtctctgtgggtaatacgctgtactatgttaacaaacaggaggggcagtcactttacgtgaagggagagccaatcattaacttttatgatccgctggtattccccagtgacgaatttgatgctagcatctcccaagtcaatgagaaaattaaccagtctttggccttcataaggaagtcggacgaactcctgcacaatgtgaacgcgggcaagagcacaaccaatatcatgattactaccatcatcattgttataatcgtgattttactgtccctaatcgccgtcggcctcctgctttactgcaaagcacggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6534 - RNA, 1943 nt, synthetic construct
  misc_feature 1..1943: note = mRNA product Design c-2 comprising derived and/or modified sequence from HRSV(A2)__F-del_DSCav1_mut6 (opt4)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6535 - RNA, 1943 nt, synthetic construct
  misc_feature 1..1943: note = mRNA product Design c-2 comprising derived and/or modified sequence from HRSV(A2)__F-del_DSCav1_mut6 (opt5)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagatgctgatgtgtagcacccccgccacaggatccggctctgctattgccagcggggtcgcggtgtgcaaggttctgcacctcgagggagaggtgaacaaaatcaagtccgccctgcttagcaccaataaagctgtcgtgtctctgtccaacggcgttagcgtgctcacatttaaggtcctggatcttaagaattacattgacaaacagctgctccctatcctgaacaagcaatcttgttccattccgaatcccgaaaccgtgatggagttccagcagaaaaacaatcggctgctcgaaatcacgcgcgagtttagcgtgaacgccggcgtcacaacccctgtttctacatatatgctgaccaattccgagcttctgagcctcattaacgatatgcccatcaccaacgaccagaagaaactgatgtccaataacgtgcaaatcgtgagacagcagtcttacagcattatgtgcatcattaaggaagaggtccttgcttatgtggttcagctgcctctctacggggtgatcgatacaccctgttggaaactgcatacgtcccctctgtgcaccacaaataccaaggaaggaagcaacatttgtctcacacggaccgaccgcggctggtactgcgataatgccgggtctgtctccttctttccgcaagcggagacgtgtaaggtgtgcagcaacagagttttctgcgacacaatgaactctctgacccttcccagcgaagtgaatctgtgtaatgtcgatatctttaaccctaaatatgactgcaagatcatgacctccaaaacagatgtgtctagctccgtcattaccagcctcggagccatcgtgtcttgttacggcaagacaaaatgcacggcttccaataagaacaaggggattatcaaaaccttcagcaatggatgtgactatgtttctaacaagggcgtggacacagtctccgtgggcaataccctgtactatgttaacaaacaggaggggcagagcctttacgtgaagggagagcccattatcaacttttatgatcctctggtcttcccctccgacgaatttgatgcctctatcagccaagtgaatgagaaaattaaccagtccctcgctttcatccggaagtctgacgaactgctgcacaatgtgaacgccggcaagagcacaaccaatattatgatcacgaccattatcattgttatcatcgtcattctcctgtcccttatcgccgtggggctgctcctgtactgcaaagctcgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6536 - RNA, 1943 nt, synthetic construct
  misc_feature 1..1943: note = mRNA product Design c-2 comprising derived and/or modified sequence from HRSV(A2)__F-del_DSCav1_mut6 (opt6)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactactcatattaaaagcaaacgcaataacaacgatattaacagctgtaacattctgctttgcatcaggccaaaatatcaccgaagaattttatcaaagcacatgctctgcagtatccaaaggatacttaggagcattaagaacaggctggtacacatccgtaataacaatagaactatcaaacatcaaagaaaacaaatgcaacggcacagacgccaaagtaaaactcataaaacaagaactagacaaatataaaaacgcagtaacagatctacaaatgctcatgtgctccacaccagcaaccggatctggttcagccatagcatccggcgtagccgtctgcaaagtattacacctcgaaggagaagtaaacaaaataaaatctgccctattatctacaaataaagccgtagtaagtctaagtaacggagtatcagtactaacatttaaagtcctagacctgaaaaactatatcgacaaacaactattaccaatactaaacaaacaatcctgttccatccctaacccagaaacagttatggaatttcaacaaaaaaataaccgccttttagaaataactagagaattttcagtaaacgcaggagttacaacaccagtatcaacatacatgctaacaaattcagaattattatcccttataaatgacatgcctatcacaaacgatcaaaaaaaattaatgtccaacaacgtacaaatagtaagacaacaatcatattccatcatgtgcatcataaaagaagaagtcctcgcatacgtagtgcaactaccactatacggagtcatagatacaccctgttggaaacttcacacatctccactatgcacaacaaacacgaaagaaggatccaacatatgcctaacacgaacagacagaggatggtattgcgacaacgctggaagtgtgagcttcttccctcaagcagaaacttgcaaagtatgcagcaatcgtgtattctgcgacacaatgaactcattaacactcccaagcgaagtaaacctctgcaatgtagacatctttaatccaaaatacgattgtaaaataatgacttcaaaaacagacgtctcatcatctgtaataacatctttaggagcaatagtttcttgctacggtaaaacaaaatgcaccgcatccaacaaaaacaaaggaataataaaaacattctctaacggctgcgattacgtatctaacaaaggagttgacacagtctcagtaggaaacacactatactacgtaaacaaacaagaaggacaaagcctatacgtaaaaggagaaccaataataaacttctatgacccattagtatttccaagcgatgaatttgacgcttcaatatcacaagtcaatgaaaaaataaatcagagcttagcattcataagaaaatctgatgaactactacacaatgtaaatgcaggaaaatccactaccaacataatgattaccacaattataatagttatcatagtaatactattatcactaatagccgttggattactactatactgcaaagcaagataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6537 - RNA, 1943 nt, synthetic construct
  misc_feature 1..1943: note = mRNA product Design c-2 comprising derived and/or modified sequence from HRSV(A2)__F-del_DSCav1_mut6 (opt11)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactactcatcctaaaagcaaacgccatcaccaccatactaaccgccgtcaccttctgcttcgcctcgggacaaaacatcaccgaagagttctaccagtcaacgtgctccgccgtctcaaaaggctacctaggcgccctccgcaccgggtggtatacctccgtcataactatcgaactctctaacatcaaagaaaacaaatgtaacggcaccgacgccaaagtcaaactaatcaaacaagaactggacaaatacaaaaacgccgtcaccgacctacaaatgctcatgtgctccactccagccaccggctccggtagcgcaatcgcctcaggcgtagctgtatgcaaagtcctccacctagaaggcgaagtaaacaaaataaaatccgccctcctctcaaccaacaaggccgtcgtctcactctcaaacggcgtctccgtactcacctttaaagtcctagaccttaaaaactacatcgacaaacaactgctaccaatcctcaacaaacaatcatgcagcatcccaaacccggaaacagtcatggagttccaacagaaaaacaaccgactcctcgaaatcacccgcgagttctccgtcaacgccggagtcaccacacctgtaagcacatacatgcttactaattccgaactcctttcactaataaacgacatgccaataaccaacgaccaaaagaaactcatgtccaacaacgtacaaatcgtacgccaacaatcctactccatcatgtgcatcatcaaagaagaagtcctggcctatgtcgtacaactccccctttacggtgtcatcgacacaccctgctggaaactacacaccagccccctctgcacaacaaacaccaaagaaggctccaacatctgcctcacccgtaccgaccgaggctggtactgcgacaacgccggctccgtctccttcttcccccaagccgaaacctgcaaagtctgcagcaaccgcgtcttctgcgataccatgaactccctcacactcccatctgaagtcaacctctgcaacgtcgatattttcaatccaaaatacgactgcaaaatcatgactagcaaaaccgacgttagctcctccgtcatcacctccctcggcgccatagtttcatgctacggcaaaaccaaatgcaccgcctccaacaaaaacaaaggcatcataaaaaccttctccaacgggtgcgactacgtatctaataaaggagtcgacaccgtctcagtaggaaacaccctctactatgtcaacaaacaagaaggccaatcactatacgttaaaggcgaaccaatcatcaacttctacgacccactcgtcttccccagcgacgagtttgacgcctcaatctcgcaagtcaatgaaaagattaaccaatccctagccttcatccgaaaaagtgacgaactcctccacaacgttaacgccggcaaatctacaaccaacatcatgatcaccactataatcatcgtcatcatagtcatacttctcagcctcatcgcagtcggactcctcctttattgcaaggcacgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6538 - RNA, 1920 nt, synthetic construct
  misc_feature 1..1920: note = mRNA product Design c-3 comprising derived and/or modified sequence from HRSV(A2)__F-del_DSCav1_mut6 (opt1)
  source 1..1920: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaaccccgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6539 - RNA, 1920 nt, synthetic construct
  misc_feature 1..1920: note = mRNA product Design c-3 comprising derived and/or modified sequence from HRSV(A2)__F-del_DSCav1_mut6 (opt1)
  source 1..1920: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctcatgtgcagcacccccgccaccgggtccggcagcgccatcgcctccggcgtggcggtgtgcaaggtcctgcacctggagggggaggtgaacaagatcaagagcgccctcctgtccaccaacaaggccgtggtcagcctgtccaacggcgtgagcgtgctcacgttcaaggtcctggacctgaagaactacatcgacaagcagctcctgccgatcctgaacaagcagtcctgcagcatccccaaccccgagaccgtgatggagttccagcagaagaacaaccggctcctggagatcacccgcgagttctccgtgaacgccggggtcaccacgcccgtgagcacctacatgctgaccaactccgagctcctgagcctgatcaacgacatgccgatcaccaacgaccagaagaagctcatgagcaacaacgtgcagatcgtccggcagcagtcctacagcatcatgtgcatcatcaaggaggaggtgctggcctacgtggtccagctgcccctctacggcgtgatcgacacgccctgctggaagctgcacaccagccccctgtgcaccaccaacacgaaggaggggagcaacatctgcctcacccgcaccgaccggggctggtactgcgacaacgcgggctccgtgagcttcttcccgcaggccgagacctgcaaggtctgctccaaccgcgtgttctgcgacacgatgaacagcctgaccctgccctccgaggtcaacctctgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaacaaggggatcatcaagaccttctccaacggctgcgactacgtgagcaacaagggcgtcgacacggtgtccgtggggaacaccctgtactacgtcaacaagcaggagggccagagcctctacgtgaagggggagcccatcatcaacttctacgacccgctggtgttccccagcgacgagttcgacgcctccatcagccaggtcaacgagaagatcaaccagtccctggcgttcatccggaagtccgacgagctcctgcacaacgtgaacgccggcaagtccaccaccaacatcatgatcaccacgatcatcatcgtgatcatcgtcatcctgctcagcctgatcgccgtggggctgctcctgtactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6540 - RNA, 1920 nt, synthetic construct
  misc_feature 1..1920: note = mRNA product Design c-3 comprising derived and/or modified sequence from HRSV(A2)__F-del_DSCav1_mut6 (opt2)
  source 1..1920: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6541 - RNA, 1920 nt, synthetic construct
  misc_feature 1..1920: note = mRNA product Design c-3 comprising derived and/or modified sequence from HRSV(A2)__F-del_DSCav1_mut6 (opt3)
  source 1..1920: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagatgcttatgtgttccacacccgccaccgggtctggatcggctatagcatcaggcgtggccgtctgcaaggtgctgcacttggagggtgaggttaacaaaatcaagagcgctctcctgagtacgaataaagccgtggtctccctgtctaacggggtgagcgtactcacttttaaggttttagatctgaagaattacattgacaaacagcttttgcctatcctgaacaagcaatcctgttcaattccaaatccggaaaccgtgatggagttccagcagaaaaacaataggctactcgaaatcacacgggagtttagtgtcaacgcgggagtgactacccccgtgagcacatatatgctgaccaattctgagcttctgtccttgataaacgatatgcctattacgaacgaccagaagaaactcatgtcaaataacgtccaaatcgttcgccagcagagctacagtattatgtgcatcatcaaggaagaggtgctggcatatgtagtgcagttaccactgtacggcgtcattgatactccctgttggaaactccatacatctcctctttgcaccactaatacaaaggaaggctccaacatatgtctgacccgaacggaccgtgggtggtactgcgataatgccggaagcgtgtcgttctttccacaagctgagacctgtaaggtttgctctaacagagtgttctgcgacacaatgaactccttgactctaccctcagaagtcaatctgtgtaatgtggatatctttaaccctaaatatgactgcaagattatgaccagtaaaacagatgtaagctcctctgttatcactagcctcggtgccatagtgtcatgttacggcaagaccaaatgcacagcaagtaataagaacaaggggattatcaaaaccttctccaatggatgtgactatgtcagcaacaagggcgtggacactgtctctgtgggtaatacgctgtactatgttaacaaacaggaggggcagtcactttacgtgaagggagagccaatcattaacttttatgatccgctggtattccccagtgacgaatttgatgctagcatctcccaagtcaatgagaaaattaaccagtctttggccttcataaggaagtcggacgaactcctgcacaatgtgaacgcgggcaagagcacaaccaatatcatgattactaccatcatcattgttataatcgtgattttactgtccctaatcgccgtcggcctcctgctttactgcaaagcacggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6542 - RNA, 1920 nt, synthetic construct
  misc_feature 1..1920: note = mRNA product Design c-3 comprising derived and/or modified sequence from HRSV(A2)__F-del_DSCav1_mut6 (opt4)
  source 1..1920: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6543 - RNA, 1920 nt, synthetic construct
  misc_feature 1..1920: note = mRNA product Design c-3 comprising derived and/or modified sequence from HRSV(A2)__F-del_DSCav1_mut6 (opt5)
  source 1..1920: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagatgctgatgtgtagcacccccgccacaggatccggctctgctattgccagcggggtcgcggtgtgcaaggttctgcacctcgagggagaggtgaacaaaatcaagtccgccctgcttagcaccaataaagctgtcgtgtctctgtccaacggcgttagcgtgctcacatttaaggtcctggatcttaagaattacattgacaaacagctgctccctatcctgaacaagcaatcttgttccattccgaatcccgaaaccgtgatggagttccagcagaaaaacaatcggctgctcgaaatcacgcgcgagtttagcgtgaacgccggcgtcacaacccctgtttctacatatatgctgaccaattccgagcttctgagcctcattaacgatatgcccatcaccaacgaccagaagaaactgatgtccaataacgtgcaaatcgtgagacagcagtcttacagcattatgtgcatcattaaggaagaggtccttgcttatgtggttcagctgcctctctacggggtgatcgatacaccctgttggaaactgcatacgtcccctctgtgcaccacaaataccaaggaaggaagcaacatttgtctcacacggaccgaccgcggctggtactgcgataatgccgggtctgtctccttctttccgcaagcggagacgtgtaaggtgtgcagcaacagagttttctgcgacacaatgaactctctgacccttcccagcgaagtgaatctgtgtaatgtcgatatctttaaccctaaatatgactgcaagatcatgacctccaaaacagatgtgtctagctccgtcattaccagcctcggagccatcgtgtcttgttacggcaagacaaaatgcacggcttccaataagaacaaggggattatcaaaaccttcagcaatggatgtgactatgtttctaacaagggcgtggacacagtctccgtgggcaataccctgtactatgttaacaaacaggaggggcagagcctttacgtgaagggagagcccattatcaacttttatgatcctctggtcttcccctccgacgaatttgatgcctctatcagccaagtgaatgagaaaattaaccagtccctcgctttcatccggaagtctgacgaactgctgcacaatgtgaacgccggcaagagcacaaccaatattatgatcacgaccattatcattgttatcatcgtcattctcctgtcccttatcgccgtggggctgctcctgtactgcaaagctcgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6544 - RNA, 1920 nt, synthetic construct
  misc_feature 1..1920: note = mRNA product Design c-3 comprising derived and/or modified sequence from HRSV(A2)__F-del_DSCav1_mut6 (opt6)
  source 1..1920: mol_type = other RNA
gggagagtccgctcagccaggttgcagaagcggcttagcgtgtgtcctaatcttctctctgcgtgtaggtaggcctgtgccgcaaacaagcttaccatggaactactcatattaaaagcaaacgcaataacaacgatattaacagctgtaacattctgctttgcatcaggccaaaatatcaccgaagaattttatcaaagcacatgctctgcagtatccaaaggatacttaggagcattaagaacaggctggtacacatccgtaataacaatagaactatcaaacatcaaagaaaacaaatgcaacggcacagacgccaaagtaaaactcataaaacaagaactagacaaatataaaaacgcagtaacagatctacaaatgctcatgtgctccacaccagcaaccggatctggttcagccatagcatccggcgtagccgtctgcaaagtattacacctcgaaggagaagtaaacaaaataaaatctgccctattatctacaaataaagccgtagtaagtctaagtaacggagtatcagtactaacatttaaagtcctagacctgaaaaactatatcgacaaacaactattaccaatactaaacaaacaatcctgttccatccctaacccagaaacagttatggaatttcaacaaaaaaataaccgccttttagaaataactagagaattttcagtaaacgcaggagttacaacaccagtatcaacatacatgctaacaaattcagaattattatcccttataaatgacatgcctatcacaaacgatcaaaaaaaattaatgtccaacaacgtacaaatagtaagacaacaatcatattccatcatgtgcatcataaaagaagaagtcctcgcatacgtagtgcaactaccactatacggagtcatagatacaccctgttggaaacttcacacatctccactatgcacaacaaacacgaaagaaggatccaacatatgcctaacacgaacagacagaggatggtattgcgacaacgctggaagtgtgagcttcttccctcaagcagaaacttgcaaagtatgcagcaatcgtgtattctgcgacacaatgaactcattaacactcccaagcgaagtaaacctctgcaatgtagacatctttaatccaaaatacgattgtaaaataatgacttcaaaaacagacgtctcatcatctgtaataacatctttaggagcaatagtttcttgctacggtaaaacaaaatgcaccgcatccaacaaaaacaaaggaataataaaaacattctctaacggctgcgattacgtatctaacaaaggagttgacacagtctcagtaggaaacacactatactacgtaaacaaacaagaaggacaaagcctatacgtaaaaggagaaccaataataaacttctatgacccattagtatttccaagcgatgaatttgacgcttcaatatcacaagtcaatgaaaaaataaatcagagcttagcattcataagaaaatctgatgaactactacacaatgtaaatgcaggaaaatccactaccaacataatgattaccacaattataatagttatcatagtaatactattatcactaatagccgttggattactactatactgcaaagcaagataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6545 - RNA, 1920 nt, synthetic construct
  misc_feature 1..1920: note = mRNA product Design c-3 comprising derived and/or modified sequence from HRSV(A2)__F-del_DSCav1_mut6 (opt11)
  source 1..1920: mol_type = other RNA
gggagagtccgctcagccaggttgcagaagcggcttagcgtgtgtcctaatcttctctctgcgtgtaggtaggcctgtgccgcaaacaagcttaccatggaactactcatcctaaaagcaaacgccatcaccaccatactaaccgccgtcaccttctgcttcgcctcgggacaaaacatcaccgaagagttctaccagtcaacgtgctccgccgtctcaaaaggctacctaggcgccctccgcaccgggtggtatacctccgtcataactatcgaactctctaacatcaaagaaaacaaatgtaacggcaccgacgccaaagtcaaactaatcaaacaagaactggacaaatacaaaaacgccgtcaccgacctacaaatgctcatgtgctccactccagccaccggctccggtagcgcaatcgcctcaggcgtagctgtatgcaaagtcctccacctagaaggcgaagtaaacaaaataaaatccgccctcctctcaaccaacaaggccgtcgtctcactctcaaacggcgtctccgtactcacctttaaagtcctagaccttaaaaactacatcgacaaacaactgctaccaatcctcaacaaacaatcatgcagcatcccaaacccggaaacagtcatggagttccaacagaaaaacaaccgactcctcgaaatcacccgcgagttctccgtcaacgccggagtcaccacacctgtaagcacatacatgcttactaattccgaactcctttcactaataaacgacatgccaataaccaacgaccaaaagaaactcatgtccaacaacgtacaaatcgtacgccaacaatcctactccatcatgtgcatcatcaaagaagaagtcctggcctatgtcgtacaactccccctttacggtgtcatcgacacaccctgctggaaactacacaccagccccctctgcacaacaaacaccaaagaaggctccaacatctgcctcacccgtaccgaccgaggctggtactgcgacaacgccggctccgtctccttcttcccccaagccgaaacctgcaaagtctgcagcaaccgcgtcttctgcgataccatgaactccctcacactcccatctgaagtcaacctctgcaacgtcgatattttcaatccaaaatacgactgcaaaatcatgactagcaaaaccgacgttagctcctccgtcatcacctccctcggcgccatagtttcatgctacggcaaaaccaaatgcaccgcctccaacaaaaacaaaggcatcataaaaaccttctccaacgggtgcgactacgtatctaataaaggagtcgacaccgtctcagtaggaaacaccctctactatgtcaacaaacaagaaggccaatcactatacgttaaaggcgaaccaatcatcaacttctacgacccactcgtcttccccagcgacgagtttgacgcctcaatctcgcaagtcaatgaaaagattaaccaatccctagccttcatccgaaaaagtgacgaactcctccacaacgttaacgccggcaaatctacaaccaacatcatgatcaccactataatcatcgtcatcatagtcatacttctcagcctcatcgcagtcggactcctcctttattgcaaggcacgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6546 - RNA, 1916 nt, synthetic construct
  misc_feature 1..1916: note = mRNA product Design c-4 comprising derived and/or modified sequence from HRSV(A2)__F-del_DSCav1_mut6 (opt1)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaaccccgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6547 - RNA, 1916 nt, synthetic construct
  misc_feature 1..1916: note = mRNA product Design c-4 comprising derived and/or modified sequence from HRSV(A2)__F-del_DSCav1_mut6 (opt1)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctcatgtgcagcacccccgccaccgggtccggcagcgccatcgcctccggcgtggcggtgtgcaaggtcctgcacctggagggggaggtgaacaagatcaagagcgccctcctgtccaccaacaaggccgtggtcagcctgtccaacggcgtgagcgtgctcacgttcaaggtcctggacctgaagaactacatcgacaagcagctcctgccgatcctgaacaagcagtcctgcagcatccccaaccccgagaccgtgatggagttccagcagaagaacaaccggctcctggagatcacccgcgagttctccgtgaacgccggggtcaccacgcccgtgagcacctacatgctgaccaactccgagctcctgagcctgatcaacgacatgccgatcaccaacgaccagaagaagctcatgagcaacaacgtgcagatcgtccggcagcagtcctacagcatcatgtgcatcatcaaggaggaggtgctggcctacgtggtccagctgcccctctacggcgtgatcgacacgccctgctggaagctgcacaccagccccctgtgcaccaccaacacgaaggaggggagcaacatctgcctcacccgcaccgaccggggctggtactgcgacaacgcgggctccgtgagcttcttcccgcaggccgagacctgcaaggtctgctccaaccgcgtgttctgcgacacgatgaacagcctgaccctgccctccgaggtcaacctctgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaacaaggggatcatcaagaccttctccaacggctgcgactacgtgagcaacaagggcgtcgacacggtgtccgtggggaacaccctgtactacgtcaacaagcaggagggccagagcctctacgtgaagggggagcccatcatcaacttctacgacccgctggtgttccccagcgacgagttcgacgcctccatcagccaggtcaacgagaagatcaaccagtccctggcgttcatccggaagtccgacgagctcctgcacaacgtgaacgccggcaagtccaccaccaacatcatgatcaccacgatcatcatcgtgatcatcgtcatcctgctcagcctgatcgccgtggggctgctcctgtactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6548 - RNA, 1916 nt, synthetic construct
  misc_feature 1..1916: note = mRNA product Design c-4 comprising derived and/or modified sequence from HRSV(A2)__F-del_DSCav1_mut6 (opt2)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6549 - RNA, 1916 nt, synthetic construct
  misc_feature 1..1916: note = mRNA product Design c-4 comprising derived and/or modified sequence from HRSV(A2)__F-del_DSCav1_mut6 (opt3)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagatgcttatgtgttccacacccgccaccgggtctggatcggctatagcatcaggcgtggccgtctgcaaggtgctgcacttggagggtgaggttaacaaaatcaagagcgctctcctgagtacgaataaagccgtggtctccctgtctaacggggtgagcgtactcacttttaaggttttagatctgaagaattacattgacaaacagcttttgcctatcctgaacaagcaatcctgttcaattccaaatccggaaaccgtgatggagttccagcagaaaaacaataggctactcgaaatcacacgggagtttagtgtcaacgcgggagtgactacccccgtgagcacatatatgctgaccaattctgagcttctgtccttgataaacgatatgcctattacgaacgaccagaagaaactcatgtcaaataacgtccaaatcgttcgccagcagagctacagtattatgtgcatcatcaaggaagaggtgctggcatatgtagtgcagttaccactgtacggcgtcattgatactccctgttggaaactccatacatctcctctttgcaccactaatacaaaggaaggctccaacatatgtctgacccgaacggaccgtgggtggtactgcgataatgccggaagcgtgtcgttctttccacaagctgagacctgtaaggtttgctctaacagagtgttctgcgacacaatgaactccttgactctaccctcagaagtcaatctgtgtaatgtggatatctttaaccctaaatatgactgcaagattatgaccagtaaaacagatgtaagctcctctgttatcactagcctcggtgccatagtgtcatgttacggcaagaccaaatgcacagcaagtaataagaacaaggggattatcaaaaccttctccaatggatgtgactatgtcagcaacaagggcgtggacactgtctctgtgggtaatacgctgtactatgttaacaaacaggaggggcagtcactttacgtgaagggagagccaatcattaacttttatgatccgctggtattccccagtgacgaatttgatgctagcatctcccaagtcaatgagaaaattaaccagtctttggccttcataaggaagtcggacgaactcctgcacaatgtgaacgcgggcaagagcacaaccaatatcatgattactaccatcatcattgttataatcgtgattttactgtccctaatcgccgtcggcctcctgctttactgcaaagcacggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6550 - RNA, 1916 nt, synthetic construct
  misc_feature 1..1916: note = mRNA product Design c-4 comprising derived and/or modified sequence from HRSV(A2)__F-del_DSCav1_mut6 (opt4)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6551 - RNA, 1916 nt, synthetic construct
  misc_feature 1..1916: note = mRNA product Design c-4 comprising derived and/or modified sequence from HRSV(A2)__F-del_DSCav1_mut6 (opt5)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagatgctgatgtgtagcacccccgccacaggatccggctctgctattgccagcggggtcgcggtgtgcaaggttctgcacctcgagggagaggtgaacaaaatcaagtccgccctgcttagcaccaataaagctgtcgtgtctctgtccaacggcgttagcgtgctcacatttaaggtcctggatcttaagaattacattgacaaacagctgctccctatcctgaacaagcaatcttgttccattccgaatcccgaaaccgtgatggagttccagcagaaaaacaatcggctgctcgaaatcacgcgcgagtttagcgtgaacgccggcgtcacaacccctgtttctacatatatgctgaccaattccgagcttctgagcctcattaacgatatgcccatcaccaacgaccagaagaaactgatgtccaataacgtgcaaatcgtgagacagcagtcttacagcattatgtgcatcattaaggaagaggtccttgcttatgtggttcagctgcctctctacggggtgatcgatacaccctgttggaaactgcatacgtcccctctgtgcaccacaaataccaaggaaggaagcaacatttgtctcacacggaccgaccgcggctggtactgcgataatgccgggtctgtctccttctttccgcaagcggagacgtgtaaggtgtgcagcaacagagttttctgcgacacaatgaactctctgacccttcccagcgaagtgaatctgtgtaatgtcgatatctttaaccctaaatatgactgcaagatcatgacctccaaaacagatgtgtctagctccgtcattaccagcctcggagccatcgtgtcttgttacggcaagacaaaatgcacggcttccaataagaacaaggggattatcaaaaccttcagcaatggatgtgactatgtttctaacaagggcgtggacacagtctccgtgggcaataccctgtactatgttaacaaacaggaggggcagagcctttacgtgaagggagagcccattatcaacttttatgatcctctggtcttcccctccgacgaatttgatgcctctatcagccaagtgaatgagaaaattaaccagtccctcgctttcatccggaagtctgacgaactgctgcacaatgtgaacgccggcaagagcacaaccaatattatgatcacgaccattatcattgttatcatcgtcattctcctgtcccttatcgccgtggggctgctcctgtactgcaaagctcgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6552 - RNA, 1916 nt, synthetic construct
  misc_feature 1..1916: note = mRNA product Design c-4 comprising derived and/or modified sequence from HRSV(A2)__F-del_DSCav1_mut6 (opt6)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggaactactcatattaaaagcaaacgcaataacaacgatattaacagctgtaacattctgctttgcatcaggccaaaatatcaccgaagaattttatcaaagcacatgctctgcagtatccaaaggatacttaggagcattaagaacaggctggtacacatccgtaataacaatagaactatcaaacatcaaagaaaacaaatgcaacggcacagacgccaaagtaaaactcataaaacaagaactagacaaatataaaaacgcagtaacagatctacaaatgctcatgtgctccacaccagcaaccggatctggttcagccatagcatccggcgtagccgtctgcaaagtattacacctcgaaggagaagtaaacaaaataaaatctgccctattatctacaaataaagccgtagtaagtctaagtaacggagtatcagtactaacatttaaagtcctagacctgaaaaactatatcgacaaacaactattaccaatactaaacaaacaatcctgttccatccctaacccagaaacagttatggaatttcaacaaaaaaataaccgccttttagaaataactagagaattttcagtaaacgcaggagttacaacaccagtatcaacatacatgctaacaaattcagaattattatcccttataaatgacatgcctatcacaaacgatcaaaaaaaattaatgtccaacaacgtacaaatagtaagacaacaatcatattccatcatgtgcatcataaaagaagaagtcctcgcatacgtagtgcaactaccactatacggagtcatagatacaccctgttggaaacttcacacatctccactatgcacaacaaacacgaaagaaggatccaacatatgcctaacacgaacagacagaggatggtattgcgacaacgctggaagtgtgagcttcttccctcaagcagaaacttgcaaagtatgcagcaatcgtgtattctgcgacacaatgaactcattaacactcccaagcgaagtaaacctctgcaatgtagacatctttaatccaaaatacgattgtaaaataatgacttcaaaaacagacgtctcatcatctgtaataacatctttaggagcaatagtttcttgctacggtaaaacaaaatgcaccgcatccaacaaaaacaaaggaataataaaaacattctctaacggctgcgattacgtatctaacaaaggagttgacacagtctcagtaggaaacacactatactacgtaaacaaacaagaaggacaaagcctatacgtaaaaggagaaccaataataaacttctatgacccattagtatttccaagcgatgaatttgacgcttcaatatcacaagtcaatgaaaaaataaatcagagcttagcattcataagaaaatctgatgaactactacacaatgtaaatgcaggaaaatccactaccaacataatgattaccacaattataatagttatcatagtaatactattatcactaatagccgttggattactactatactgcaaagcaagataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6553 - RNA, 1916 nt, synthetic construct
  misc_feature 1..1916: note = mRNA product Design c-4 comprising derived and/or modified sequence from HRSV(A2)__F-del_DSCav1_mut6 (opt11)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggaactactcatcctaaaagcaaacgccatcaccaccatactaaccgccgtcaccttctgcttcgcctcgggacaaaacatcaccgaagagttctaccagtcaacgtgctccgccgtctcaaaaggctacctaggcgccctccgcaccgggtggtatacctccgtcataactatcgaactctctaacatcaaagaaaacaaatgtaacggcaccgacgccaaagtcaaactaatcaaacaagaactggacaaatacaaaaacgccgtcaccgacctacaaatgctcatgtgctccactccagccaccggctccggtagcgcaatcgcctcaggcgtagctgtatgcaaagtcctccacctagaaggcgaagtaaacaaaataaaatccgccctcctctcaaccaacaaggccgtcgtctcactctcaaacggcgtctccgtactcacctttaaagtcctagaccttaaaaactacatcgacaaacaactgctaccaatcctcaacaaacaatcatgcagcatcccaaacccggaaacagtcatggagttccaacagaaaaacaaccgactcctcgaaatcacccgcgagttctccgtcaacgccggagtcaccacacctgtaagcacatacatgcttactaattccgaactcctttcactaataaacgacatgccaataaccaacgaccaaaagaaactcatgtccaacaacgtacaaatcgtacgccaacaatcctactccatcatgtgcatcatcaaagaagaagtcctggcctatgtcgtacaactccccctttacggtgtcatcgacacaccctgctggaaactacacaccagccccctctgcacaacaaacaccaaagaaggctccaacatctgcctcacccgtaccgaccgaggctggtactgcgacaacgccggctccgtctccttcttcccccaagccgaaacctgcaaagtctgcagcaaccgcgtcttctgcgataccatgaactccctcacactcccatctgaagtcaacctctgcaacgtcgatattttcaatccaaaatacgactgcaaaatcatgactagcaaaaccgacgttagctcctccgtcatcacctccctcggcgccatagtttcatgctacggcaaaaccaaatgcaccgcctccaacaaaaacaaaggcatcataaaaaccttctccaacgggtgcgactacgtatctaataaaggagtcgacaccgtctcagtaggaaacaccctctactatgtcaacaaacaagaaggccaatcactatacgttaaaggcgaaccaatcatcaacttctacgacccactcgtcttccccagcgacgagtttgacgcctcaatctcgcaagtcaatgaaaagattaaccaatccctagccttcatccgaaaaagtgacgaactcctccacaacgttaacgccggcaaatctacaaccaacatcatgatcaccactataatcatcgtcatcatagtcatacttctcagcctcatcgcagtcggactcctcctttattgcaaggcacgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6554 - RNA, 1834 nt, synthetic construct
  misc_feature 1..1834: note = mRNA product Design c-5 comprising derived and/or modified sequence from HRSV(A2)__F-del_DSCav1_mut6 (opt1)
  source 1..1834: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaaccccgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6555 - RNA, 1834 nt, synthetic construct
  misc_feature 1..1834: note = mRNA product Design c-5 comprising derived and/or modified sequence from HRSV(A2)__F-del_DSCav1_mut6 (opt1)
  source 1..1834: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctcatgtgcagcacccccgccaccgggtccggcagcgccatcgcctccggcgtggcggtgtgcaaggtcctgcacctggagggggaggtgaacaagatcaagagcgccctcctgtccaccaacaaggccgtggtcagcctgtccaacggcgtgagcgtgctcacgttcaaggtcctggacctgaagaactacatcgacaagcagctcctgccgatcctgaacaagcagtcctgcagcatccccaaccccgagaccgtgatggagttccagcagaagaacaaccggctcctggagatcacccgcgagttctccgtgaacgccggggtcaccacgcccgtgagcacctacatgctgaccaactccgagctcctgagcctgatcaacgacatgccgatcaccaacgaccagaagaagctcatgagcaacaacgtgcagatcgtccggcagcagtcctacagcatcatgtgcatcatcaaggaggaggtgctggcctacgtggtccagctgcccctctacggcgtgatcgacacgccctgctggaagctgcacaccagccccctgtgcaccaccaacacgaaggaggggagcaacatctgcctcacccgcaccgaccggggctggtactgcgacaacgcgggctccgtgagcttcttcccgcaggccgagacctgcaaggtctgctccaaccgcgtgttctgcgacacgatgaacagcctgaccctgccctccgaggtcaacctctgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaacaaggggatcatcaagaccttctccaacggctgcgactacgtgagcaacaagggcgtcgacacggtgtccgtggggaacaccctgtactacgtcaacaagcaggagggccagagcctctacgtgaagggggagcccatcatcaacttctacgacccgctggtgttccccagcgacgagttcgacgcctccatcagccaggtcaacgagaagatcaaccagtccctggcgttcatccggaagtccgacgagctcctgcacaacgtgaacgccggcaagtccaccaccaacatcatgatcaccacgatcatcatcgtgatcatcgtcatcctgctcagcctgatcgccgtggggctgctcctgtactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6556 - RNA, 1834 nt, synthetic construct
  misc_feature 1..1834: note = mRNA product Design c-5 comprising derived and/or modified sequence from HRSV(A2)__F-del_DSCav1_mut6 (opt2)
  source 1..1834: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6557 - RNA, 1834 nt, synthetic construct
  misc_feature 1..1834: note = mRNA product Design c-5 comprising derived and/or modified sequence from HRSV(A2)__F-del_DSCav1_mut6 (opt3)
  source 1..1834: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagatgcttatgtgttccacacccgccaccgggtctggatcggctatagcatcaggcgtggccgtctgcaaggtgctgcacttggagggtgaggttaacaaaatcaagagcgctctcctgagtacgaataaagccgtggtctccctgtctaacggggtgagcgtactcacttttaaggttttagatctgaagaattacattgacaaacagcttttgcctatcctgaacaagcaatcctgttcaattccaaatccggaaaccgtgatggagttccagcagaaaaacaataggctactcgaaatcacacgggagtttagtgtcaacgcgggagtgactacccccgtgagcacatatatgctgaccaattctgagcttctgtccttgataaacgatatgcctattacgaacgaccagaagaaactcatgtcaaataacgtccaaatcgttcgccagcagagctacagtattatgtgcatcatcaaggaagaggtgctggcatatgtagtgcagttaccactgtacggcgtcattgatactccctgttggaaactccatacatctcctctttgcaccactaatacaaaggaaggctccaacatatgtctgacccgaacggaccgtgggtggtactgcgataatgccggaagcgtgtcgttctttccacaagctgagacctgtaaggtttgctctaacagagtgttctgcgacacaatgaactccttgactctaccctcagaagtcaatctgtgtaatgtggatatctttaaccctaaatatgactgcaagattatgaccagtaaaacagatgtaagctcctctgttatcactagcctcggtgccatagtgtcatgttacggcaagaccaaatgcacagcaagtaataagaacaaggggattatcaaaaccttctccaatggatgtgactatgtcagcaacaagggcgtggacactgtctctgtgggtaatacgctgtactatgttaacaaacaggaggggcagtcactttacgtgaagggagagccaatcattaacttttatgatccgctggtattccccagtgacgaatttgatgctagcatctcccaagtcaatgagaaaattaaccagtctttggccttcataaggaagtcggacgaactcctgcacaatgtgaacgcgggcaagagcacaaccaatatcatgattactaccatcatcattgttataatcgtgattttactgtccctaatcgccgtcggcctcctgctttactgcaaagcacggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6558 - RNA, 1834 nt, synthetic construct
  misc_feature 1..1834: note = mRNA product Design c-5 comprising derived and/or modified sequence from HRSV(A2)__F-del_DSCav1_mut6 (opt4)
  source 1..1834: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6559 - RNA, 1834 nt, synthetic construct
  misc_feature 1..1834: note = mRNA product Design c-5 comprising derived and/or modified sequence from HRSV(A2)__F-del_DSCav1_mut6 (opt5)
  source 1..1834: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagatgctgatgtgtagcacccccgccacaggatccggctctgctattgccagcggggtcgcggtgtgcaaggttctgcacctcgagggagaggtgaacaaaatcaagtccgccctgcttagcaccaataaagctgtcgtgtctctgtccaacggcgttagcgtgctcacatttaaggtcctggatcttaagaattacattgacaaacagctgctccctatcctgaacaagcaatcttgttccattccgaatcccgaaaccgtgatggagttccagcagaaaaacaatcggctgctcgaaatcacgcgcgagtttagcgtgaacgccggcgtcacaacccctgtttctacatatatgctgaccaattccgagcttctgagcctcattaacgatatgcccatcaccaacgaccagaagaaactgatgtccaataacgtgcaaatcgtgagacagcagtcttacagcattatgtgcatcattaaggaagaggtccttgcttatgtggttcagctgcctctctacggggtgatcgatacaccctgttggaaactgcatacgtcccctctgtgcaccacaaataccaaggaaggaagcaacatttgtctcacacggaccgaccgcggctggtactgcgataatgccgggtctgtctccttctttccgcaagcggagacgtgtaaggtgtgcagcaacagagttttctgcgacacaatgaactctctgacccttcccagcgaagtgaatctgtgtaatgtcgatatctttaaccctaaatatgactgcaagatcatgacctccaaaacagatgtgtctagctccgtcattaccagcctcggagccatcgtgtcttgttacggcaagacaaaatgcacggcttccaataagaacaaggggattatcaaaaccttcagcaatggatgtgactatgtttctaacaagggcgtggacacagtctccgtgggcaataccctgtactatgttaacaaacaggaggggcagagcctttacgtgaagggagagcccattatcaacttttatgatcctctggtcttcccctccgacgaatttgatgcctctatcagccaagtgaatgagaaaattaaccagtccctcgctttcatccggaagtctgacgaactgctgcacaatgtgaacgccggcaagagcacaaccaatattatgatcacgaccattatcattgttatcatcgtcattctcctgtcccttatcgccgtggggctgctcctgtactgcaaagctcgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6560 - RNA, 1834 nt, synthetic construct
  misc_feature 1..1834: note = mRNA product Design c-5 comprising derived and/or modified sequence from HRSV(A2)__F-del_DSCav1_mut6 (opt6)
  source 1..1834: mol_type = other RNA
gggagagcggctcggccattttgtcccagtcagtccggaggctgcggctgcagaagtaccgcctgcggagtaactgcaaagaagcttaccatggaactactcatattaaaagcaaacgcaataacaacgatattaacagctgtaacattctgctttgcatcaggccaaaatatcaccgaagaattttatcaaagcacatgctctgcagtatccaaaggatacttaggagcattaagaacaggctggtacacatccgtaataacaatagaactatcaaacatcaaagaaaacaaatgcaacggcacagacgccaaagtaaaactcataaaacaagaactagacaaatataaaaacgcagtaacagatctacaaatgctcatgtgctccacaccagcaaccggatctggttcagccatagcatccggcgtagccgtctgcaaagtattacacctcgaaggagaagtaaacaaaataaaatctgccctattatctacaaataaagccgtagtaagtctaagtaacggagtatcagtactaacatttaaagtcctagacctgaaaaactatatcgacaaacaactattaccaatactaaacaaacaatcctgttccatccctaacccagaaacagttatggaatttcaacaaaaaaataaccgccttttagaaataactagagaattttcagtaaacgcaggagttacaacaccagtatcaacatacatgctaacaaattcagaattattatcccttataaatgacatgcctatcacaaacgatcaaaaaaaattaatgtccaacaacgtacaaatagtaagacaacaatcatattccatcatgtgcatcataaaagaagaagtcctcgcatacgtagtgcaactaccactatacggagtcatagatacaccctgttggaaacttcacacatctccactatgcacaacaaacacgaaagaaggatccaacatatgcctaacacgaacagacagaggatggtattgcgacaacgctggaagtgtgagcttcttccctcaagcagaaacttgcaaagtatgcagcaatcgtgtattctgcgacacaatgaactcattaacactcccaagcgaagtaaacctctgcaatgtagacatctttaatccaaaatacgattgtaaaataatgacttcaaaaacagacgtctcatcatctgtaataacatctttaggagcaatagtttcttgctacggtaaaacaaaatgcaccgcatccaacaaaaacaaaggaataataaaaacattctctaacggctgcgattacgtatctaacaaaggagttgacacagtctcagtaggaaacacactatactacgtaaacaaacaagaaggacaaagcctatacgtaaaaggagaaccaataataaacttctatgacccattagtatttccaagcgatgaatttgacgcttcaatatcacaagtcaatgaaaaaataaatcagagcttagcattcataagaaaatctgatgaactactacacaatgtaaatgcaggaaaatccactaccaacataatgattaccacaattataatagttatcatagtaatactattatcactaatagccgttggattactactatactgcaaagcaagataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6561 - RNA, 1834 nt, synthetic construct
  misc_feature 1..1834: note = mRNA product Design c-5 comprising derived and/or modified sequence from HRSV(A2)__F-del_DSCav1_mut6 (opt11)
  source 1..1834: mol_type = other RNA
gggagagcggctcggccattttgtcccagtcagtccggaggctgcggctgcagaagtaccgcctgcggagtaactgcaaagaagcttaccatggaactactcatcctaaaagcaaacgccatcaccaccatactaaccgccgtcaccttctgcttcgcctcgggacaaaacatcaccgaagagttctaccagtcaacgtgctccgccgtctcaaaaggctacctaggcgccctccgcaccgggtggtatacctccgtcataactatcgaactctctaacatcaaagaaaacaaatgtaacggcaccgacgccaaagtcaaactaatcaaacaagaactggacaaatacaaaaacgccgtcaccgacctacaaatgctcatgtgctccactccagccaccggctccggtagcgcaatcgcctcaggcgtagctgtatgcaaagtcctccacctagaaggcgaagtaaacaaaataaaatccgccctcctctcaaccaacaaggccgtcgtctcactctcaaacggcgtctccgtactcacctttaaagtcctagaccttaaaaactacatcgacaaacaactgctaccaatcctcaacaaacaatcatgcagcatcccaaacccggaaacagtcatggagttccaacagaaaaacaaccgactcctcgaaatcacccgcgagttctccgtcaacgccggagtcaccacacctgtaagcacatacatgcttactaattccgaactcctttcactaataaacgacatgccaataaccaacgaccaaaagaaactcatgtccaacaacgtacaaatcgtacgccaacaatcctactccatcatgtgcatcatcaaagaagaagtcctggcctatgtcgtacaactccccctttacggtgtcatcgacacaccctgctggaaactacacaccagccccctctgcacaacaaacaccaaagaaggctccaacatctgcctcacccgtaccgaccgaggctggtactgcgacaacgccggctccgtctccttcttcccccaagccgaaacctgcaaagtctgcagcaaccgcgtcttctgcgataccatgaactccctcacactcccatctgaagtcaacctctgcaacgtcgatattttcaatccaaaatacgactgcaaaatcatgactagcaaaaccgacgttagctcctccgtcatcacctccctcggcgccatagtttcatgctacggcaaaaccaaatgcaccgcctccaacaaaaacaaaggcatcataaaaaccttctccaacgggtgcgactacgtatctaataaaggagtcgacaccgtctcagtaggaaacaccctctactatgtcaacaaacaagaaggccaatcactatacgttaaaggcgaaccaatcatcaacttctacgacccactcgtcttccccagcgacgagtttgacgcctcaatctcgcaagtcaatgaaaagattaaccaatccctagccttcatccgaaaaagtgacgaactcctccacaacgttaacgccggcaaatctacaaccaacatcatgatcaccactataatcatcgtcatcatagtcatacttctcagcctcatcgcagtcggactcctcctttattgcaaggcacgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6562 - RNA, 1843 nt, synthetic construct
  misc_feature 1..1843: note = mRNA product Design d-1 comprising derived and/or modified sequence from HRSV(A2)__F-del_DSCav1_mut6 (opt1)
  source 1..1843: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagatgctgatgtgctccaccccggcaaccggctccggctccgccatcgcgagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaaccccgagacggtgatggagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgtgcagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaacaaggggatcatcaagaccttctccaacggctgcgactacgtgagcaacaagggcgtggacaccgtgtccgtcgggaacaccctgtactacgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6563 - RNA, 1843 nt, synthetic construct
  misc_feature 1..1843: note = mRNA product Design d-1 comprising derived and/or modified sequence from HRSV(A2)__F-del_DSCav1_mut6 (opt1)
  source 1..1843: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagatgctcatgtgcagcacccccgccaccgggtccggcagcgccatcgcctccggcgtggcggtgtgcaaggtcctgcacctggagggggaggtgaacaagatcaagagcgccctcctgtccaccaacaaggccgtggtcagcctgtccaacggcgtgagcgtgctcacgttcaaggtcctggacctgaagaactacatcgacaagcagctcctgccgatcctgaacaagcagtcctgcagcatccccaaccccgagaccgtgatggagttccagcagaagaacaaccggctcctggagatcacccgcgagttctccgtgaacgccggggtcaccacgcccgtgagcacctacatgctgaccaactccgagctcctgagcctgatcaacgacatgccgatcaccaacgaccagaagaagctcatgagcaacaacgtgcagatcgtccggcagcagtcctacagcatcatgtgcatcatcaaggaggaggtgctggcctacgtggtccagctgcccctctacggcgtgatcgacacgccctgctggaagctgcacaccagccccctgtgcaccaccaacacgaaggaggggagcaacatctgcctcacccgcaccgaccggggctggtactgcgacaacgcgggctccgtgagcttcttcccgcaggccgagacctgcaaggtctgctccaaccgcgtgttctgcgacacgatgaacagcctgaccctgccctccgaggtcaacctctgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaacaaggggatcatcaagaccttctccaacggctgcgactacgtgagcaacaagggcgtcgacacggtgtccgtggggaacaccctgtactacgtcaacaagcaggagggccagagcctctacgtgaagggggagcccatcatcaacttctacgacccgctggtgttccccagcgacgagttcgacgcctccatcagccaggtcaacgagaagatcaaccagtccctggcgttcatccggaagtccgacgagctcctgcacaacgtgaacgccggcaagtccaccaccaacatcatgatcaccacgatcatcatcgtgatcatcgtcatcctgctcagcctgatcgccgtggggctgctcctgtactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6564 - RNA, 1843 nt, synthetic construct
  misc_feature 1..1843: note = mRNA product Design d-1 comprising derived and/or modified sequence from HRSV(A2)__F-del_DSCav1_mut6 (opt2)
  source 1..1843: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagatgctcatgtgctccacccccgccaccggctccggctccgccatcgcctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaaccccgagaccgtcatggagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtctgctccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaacaagggcatcatcaagaccttctccaacggctgcgactacgtctccaacaagggcgtcgacaccgtctccgtcggcaacaccctctactacgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6565 - RNA, 1843 nt, synthetic construct
  misc_feature 1..1843: note = mRNA product Design d-1 comprising derived and/or modified sequence from HRSV(A2)__F-del_DSCav1_mut6 (opt3)
  source 1..1843: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagatgcttatgtgttccacacccgccaccgggtctggatcggctatagcatcaggcgtggccgtctgcaaggtgctgcacttggagggtgaggttaacaaaatcaagagcgctctcctgagtacgaataaagccgtggtctccctgtctaacggggtgagcgtactcacttttaaggttttagatctgaagaattacattgacaaacagcttttgcctatcctgaacaagcaatcctgttcaattccaaatccggaaaccgtgatggagttccagcagaaaaacaataggctactcgaaatcacacgggagtttagtgtcaacgcgggagtgactacccccgtgagcacatatatgctgaccaattctgagcttctgtccttgataaacgatatgcctattacgaacgaccagaagaaactcatgtcaaataacgtccaaatcgttcgccagcagagctacagtattatgtgcatcatcaaggaagaggtgctggcatatgtagtgcagttaccactgtacggcgtcattgatactccctgttggaaactccatacatctcctctttgcaccactaatacaaaggaaggctccaacatatgtctgacccgaacggaccgtgggtggtactgcgataatgccggaagcgtgtcgttctttccacaagctgagacctgtaaggtttgctctaacagagtgttctgcgacacaatgaactccttgactctaccctcagaagtcaatctgtgtaatgtggatatctttaaccctaaatatgactgcaagattatgaccagtaaaacagatgtaagctcctctgttatcactagcctcggtgccatagtgtcatgttacggcaagaccaaatgcacagcaagtaataagaacaaggggattatcaaaaccttctccaatggatgtgactatgtcagcaacaagggcgtggacactgtctctgtgggtaatacgctgtactatgttaacaaacaggaggggcagtcactttacgtgaagggagagccaatcattaacttttatgatccgctggtattccccagtgacgaatttgatgctagcatctcccaagtcaatgagaaaattaaccagtctttggccttcataaggaagtcggacgaactcctgcacaatgtgaacgcgggcaagagcacaaccaatatcatgattactaccatcatcattgttataatcgtgattttactgtccctaatcgccgtcggcctcctgctttactgcaaagcacggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6566 - RNA, 1843 nt, synthetic construct
  misc_feature 1..1843: note = mRNA product Design d-1 comprising derived and/or modified sequence from HRSV(A2)__F-del_DSCav1_mut6 (opt4)
  source 1..1843: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagatgctgatgtgcagcacccccgccaccggcagcggcagcgccatcgccagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaaccccgagaccgtgatggagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgtgcagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacaagggcatcatcaagaccttcagcaacggctgcgactacgtgagcaacaagggcgtggacaccgtgagcgtgggcaacaccctgtactacgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6567 - RNA, 1843 nt, synthetic construct
  misc_feature 1..1843: note = mRNA product Design d-1 comprising derived and/or modified sequence from HRSV(A2)__F-del_DSCav1_mut6 (opt5)
  source 1..1843: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagatgctgatgtgtagcacccccgccacaggatccggctctgctattgccagcggggtcgcggtgtgcaaggttctgcacctcgagggagaggtgaacaaaatcaagtccgccctgcttagcaccaataaagctgtcgtgtctctgtccaacggcgttagcgtgctcacatttaaggtcctggatcttaagaattacattgacaaacagctgctccctatcctgaacaagcaatcttgttccattccgaatcccgaaaccgtgatggagttccagcagaaaaacaatcggctgctcgaaatcacgcgcgagtttagcgtgaacgccggcgtcacaacccctgtttctacatatatgctgaccaattccgagcttctgagcctcattaacgatatgcccatcaccaacgaccagaagaaactgatgtccaataacgtgcaaatcgtgagacagcagtcttacagcattatgtgcatcattaaggaagaggtccttgcttatgtggttcagctgcctctctacggggtgatcgatacaccctgttggaaactgcatacgtcccctctgtgcaccacaaataccaaggaaggaagcaacatttgtctcacacggaccgaccgcggctggtactgcgataatgccgggtctgtctccttctttccgcaagcggagacgtgtaaggtgtgcagcaacagagttttctgcgacacaatgaactctctgacccttcccagcgaagtgaatctgtgtaatgtcgatatctttaaccctaaatatgactgcaagatcatgacctccaaaacagatgtgtctagctccgtcattaccagcctcggagccatcgtgtcttgttacggcaagacaaaatgcacggcttccaataagaacaaggggattatcaaaaccttcagcaatggatgtgactatgtttctaacaagggcgtggacacagtctccgtgggcaataccctgtactatgttaacaaacaggaggggcagagcctttacgtgaagggagagcccattatcaacttttatgatcctctggtcttcccctccgacgaatttgatgcctctatcagccaagtgaatgagaaaattaaccagtccctcgctttcatccggaagtctgacgaactgctgcacaatgtgaacgccggcaagagcacaaccaatattatgatcacgaccattatcattgttatcatcgtcattctcctgtcccttatcgccgtggggctgctcctgtactgcaaagctcgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 6568 - RNA, 1843 nt, synthetic construct
  misc_feature 1..1843: note = mRNA product Design d-1 comprising derived and/or modified sequence from HRSV(A2)__F-del_DSCav1_mut6 (opt6)
  source 1..1843: mol_type = other RNA
gggagacccgtgacccggaagttgtacggctacgcgactttccctcccacaaaccctcgcgcccttcctttcctacttgggcccggcagaaagcttaccatggaactactcatattaaaagcaaacgcaataacaacgatattaacagctgtaacattctgctttgcatcaggccaaaatatcaccgaagaattttatcaaagcacatgctctgcagtatccaaaggatacttaggagcattaagaacaggctggtacacatccgtaataacaatagaactatcaaacatcaaagaaaacaaatgcaacggcacagacgccaaagtaaaactcataaaacaagaactagacaaatataaaaacgcagtaacagatctacaaatgctcatgtgctccacaccagcaaccggatctggttcagccatagcatccggcgtagccgtctgcaaagtattacacctcgaaggagaagtaaacaaaataaaatctgccctattatctacaaataaagccgtagtaagtctaagtaacggagtatcagtactaacatttaaagtcctagacctgaaaaactatatcgacaaacaactattaccaatactaaacaaacaatcctgttccatccctaacccagaaacagttatggaatttcaacaaaaaaataaccgccttttagaaataactagagaattttcagtaaacgcaggagttacaacaccagtatcaacatacatgctaacaaattcagaattattatcccttataaatgacatgcctatcacaaacgatcaaaaaaaattaatgtccaacaacgtacaaatagtaagacaacaatcatattccatcatgtgcatcataaaagaagaagtcctcgcatacgtagtgcaactaccactatacggagtcatagatacaccctgttggaaacttcacacatctccactatgcacaacaaacacgaaagaaggatccaacatatgcctaacacgaacagacagaggatggtattgcgacaacgctggaagtgtgagcttcttccctcaagcagaaacttgcaaagtatgcagcaatcgtgtattctgcgacacaatgaactcattaacactcccaagcgaagtaaacctctgcaatgtagacatctttaatccaaaatacgattgtaaaataatgacttcaaaaacagacgtctcatcatctgtaataacatctttaggagcaatagtttcttgctacggtaaaacaaaatgcaccgcatccaacaaaaacaaaggaataataaaaacattctctaacggctgcgattacgtatctaacaaaggagttgacacagtctcagtaggaaacacactatactacgtaaacaaacaagaaggacaaagcctatacgtaaaaggagaaccaataataaacttctatgacccattagtatttccaagcgatgaatttgacgcttcaatatcacaagtcaatgaaaaaataaatcagagcttagcattcataagaaaatctgatgaactactacacaatgtaaatgcaggaaaatccactaccaacataatgattaccacaattataatagttatcatagtaatactattatcactaatagccgttggattactactatactgcaaagcaagataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt
